(12) United States Patent
Farrar et al.

(10) Patent No.: US 10,220,102 B2
(45) Date of Patent: Mar. 5, 2019

(54) VARIANTS OF YEAST NDI1 GENE, AND USES THEREOF IN THE TREATMENT OF DISEASE ASSOCIATED WITH MITOCHONDRIAL DYSFUNCTION

(71) Applicant: THE PROVOST, FELLOWS, FOUNDATION SCHOLARS, AND THE OTHER MEMBERS OF BOARD, OF THE COLLEGE OF THE HOLY AND UNDIVIDED TRINITY OF QUEEN ELIZABETH, NEAR DUBLIN, Dublin (IE)

(72) Inventors: Gwyneth Jane Farrar, Dublin (IE); Sophia Millington-Ward, Dublin (IE); Naomi Chadderton, Dublin (IE); Mathew Alan Carrigan, Dublin (IE); Paul Kenna, Dublin (IE)

(73) Assignee: THE PROVOST FELLOWS FOUNDATION SCHOLARS AND THE OTHER MEMBERS OF BOARD OF THE COLLEGE OF THE HOLD AND UNDIVIDED TRINITY OF QUEEN ELIZABETH, NEAR DUBLIN TRINITY COLLEGE DUBLIN, Dublin (IE)

( * ) Notice: Subject to any disclaimer, the term of this patent is extended or adjusted under 35 U.S.C. 154(b) by 124 days.

(21) Appl. No.: 14/367,004

(22) PCT Filed: Dec. 21, 2012

(86) PCT No.: PCT/EP2012/076697
§ 371 (c)(1),
(2) Date: Jun. 19, 2014

(87) PCT Pub. No.: WO2013/093029
PCT Pub. Date: Jun. 27, 2013

(65) Prior Publication Data
US 2015/0099798 A1    Apr. 9, 2015

(30) Foreign Application Priority Data
Dec. 21, 2011 (EP) .................... 11194796

(51) Int. Cl.
*C12N 9/02* (2006.01)
*A61K 48/00* (2006.01)
*C07K 14/395* (2006.01)

(52) U.S. Cl.
CPC ........ *A61K 48/0066* (2013.01); *C07K 14/395* (2013.01); *C12N 9/0036* (2013.01); *C12Y 106/05009* (2013.01)

(58) Field of Classification Search
None
See application file for complete search history.

(56) References Cited

U.S. PATENT DOCUMENTS

| 2006/0046253 A1* | 3/2006 | Nakao | C07K 14/39 435/6.18 |
| 2011/0214199 A1* | 9/2011 | Coffin | C12N 15/1079 800/275 |

FOREIGN PATENT DOCUMENTS

WO    2001/096385    12/2001

OTHER PUBLICATIONS

Yang et al. Reaction Mechanism of Single Subunit NADH-Ubiquinone Oxidoreductase (Ndi1) from *Saccharomyces cerevisiae*. The Journal of Biological Chemistry vol. 286, No. 11, pp. 9287-9297, 2011.*
Junn et al. Mitochondrial Localization of DJ-1 Leads to Enhanced Neuroprotection. Journal of Neuroscience Research 87:123-129 (2009).*
Monahan et al. AAV vectors: is clinical success on the horizon? Gene Ther. Jan. 2000;7(1):24-30.*
Score result Coffin Sequence 31755, U.S. Appl. No. 12/157,153 Publication No. US20110214199A1 download dated 2015.*
Akao et al., DNA Research: An International Journal for Rapid Publication of Reports on Genes and Genomes,18 (6):423-434, (2011). "Whole-genome sequencing of sake yeast *Saccharomyces cerevisiae* Kyokai No. 7.".
De Vries, S. et al., European Journal of Biochemistry, 203(3):587-592, (1992). "Primary structure and import pathway of the rotenone-insensitive NADH-ubiquinone oxidoreductase of mitochondria from *Saccharomyces-cerevisiae*".
Marella et al., PLOS One, 5(7):E11472, (2010). "Successful amelioration of mitochondrial optic Neuropathy using the yeast NDI1 gene in a rat animal model."
Nielsen et al., Protein Science, Cambridge University Press, pp. 1007-1017, (2003). "Reliable prediction of T-cell epitopes using neural networks with novel sequence representations."
Wei et al., Proc Natl Acad Sci U S A., 104(31):12825-12830, (2007). "Genome sequencing and comparative analysis of *Saccharomyces cerevisiae* strain YJM789".
Zhou et al., Journal of Virology, The American Society for Microbiology, pp. 4972-4982, (1999). "Papillomavirus Capsid Protein Expression Level Depends on the Match between Codon Usage and tRNA Availability."
Ames, "CNS energy metabolism as related to function", Brain Research Reviews 34:42-68 (2000).

(Continued)

*Primary Examiner* — Catherine S Hibbert
(74) *Attorney, Agent, or Firm* — David S. Resnick; Teresa A. Ptashka; Nixon Peabody LLP

(57) ABSTRACT

An isolated nucleic acid sequence encoding the yeast NDI1 protein of SEQ ID NO: 542 or a functional variant thereof is described. The nucleic acid sequence comprises at least 50 codons which are codon optimized compared with the sequence of yeast NDI1 gene of SEQ ID NO: 1.

19 Claims, 19 Drawing Sheets

Specification includes a Sequence Listing.

(56) References Cited

OTHER PUBLICATIONS

Ayuso et al., "High AAV vector purity results in serotype- and tissue-independent enhancement of transduction efficiency", Gene Therapy 17:503-510 (2010).
Chalmers et al., "Clinical, biochemical and molecular genetic features of Leber's hereditary optic neuropathy", Biochimica et Biophysica Acta 1410:147-158 (1999).
Chaput et al., "The Emerging World of Synthetic Genetics", Chemistry & Biology 19:1360-1371 (2012).
Ellouze et al., "Optimized Allotopic Expression of the Human Mitochondrial ND4 Prevents Blindness in a Rat Model of Mitochondrial Dysfunction", The American Journal of Human Genetics 83:373-387 (2008).
Giordano et al., "Oestrogens ameliorate mitochondrial dysfunction in Leber's hereditary optic neuropathy", Brain 134:220-234 (2011).
Hudson et al., "Clinical Expression of Leber Hereditary Optic Neuropathy Is Affected by the Mitochondrial DNA—Haplogroup Background", The American Journal of Human Genetics 81:228-233 (2007).
Jarrett et al., "Mitochondrial DNA damage and its potential role in retinal degeneration", Progress in Retinal and Eye Research 27:596-607 (2008).
Koilkonda et al., "Leber's Hereditary Optic Neuropathy-Gene Therapy: From Benchtop to Bedside", Journal of Ophthalmology 2011:179412 (2011).
Kormann et al., "Expression of therapeutic proteins after delivery of chemically modified mRNA in mice", Nature Biotechnology 29(2):154-159 (2011).
Mackey et al., "Primary Pathogenic mtDNA Mutations in Multigeneration Pedigrees with Leber Hereditary Optic Neuropathy", Am. J. Hum. Genet. 59:481-485 (1996).
Marcuello et al., "Human mitochondrial variants influence on oxygen consumption", Mitochondrion 9:27-30 (2009).
Marella, "Parkinson's disease and mitochondrial complex I: a perspective on the Ndi1 therapy", J Bioenerg Biomembr. 41(6):493-497 (2009).
Palfi et al., "Adeno-Associated Virus-Mediated Rhodopsin Replacement Provides Therapeutic Benefit in Mice with a Targeted Disruption of the Rhodopsin Gene", Human Gene Therapy 21:311-323 (2010).
Porter et al., "Indirect measurement of mitochondrial proton leak and its application", International Journal of Obesity 23(Suppl 6):S12-S18 (1999).
Qi et al., "The Mutant Human ND4 Subunit of Complex I Induces Optic Neuropathy in the Mouse", Investigative Ophthalmology & Visual Science 48(1):1-10 (2007).
Rohr et al., "Fast and reliable titration of recombinant adeno-associated virus type-2 using quantitative real-time PCR", Journal of Virological Methods 106:81-88 (2002).
Shankar et al., "Evidence for a Novel X-Linked Modifier Locus for Leber Hereditary Optic Neuropathy", Ophthalmic Genetics 29(1):17-24 (2008).
Tsao et al., "Smoking as an aetiological factor in a pedigree with Leber's hereditary optic neuropathy", Br. J. Ophthalmol. 83:577-581 (1999).
Yamada et al., "High Incidence of Visual Recovery Among Four Japanese Patients with Leber's Hereditary Optic Neuropathy with the 14484 Mutation", Journal of Neuro-Ophthalmology 17(2):103-107 (1997).
Yen et al., "Leber's hereditary optic neuropathy: A multifactorial disease", Progress in Retinal and Eye Research 25:381-396 (2006).
Yu-Wai-Man et al., "Mitochondrial optic neuropathies—Disease mechanisms and therapeutic strategies", Progress in Retinal and Eye Research 30:81-114 (2011).
Database UniProtKB [Online] XP002685369, Database accession No. A6ZLU4 (Mar. 21, 2012).
Database UniProtKB [Online] XP002685371, Database accession No. G2WJT6 (Apr. 18, 2012).
International Search Report & Written Opinion for PCT/EP2012/076697, dated Jun. 20, 2013.

* cited by examiner

Oxygraphs for NDI1 construct

Oxygraphs for NDI1 and hNDI1 constructs with amino acid substitutions

A

B

C

D

E

F

G

H

Bar chart for NDI1 and hNDI1 constructs with amino acid substitutions

Oxygraphs for NDI1 and NSG constructs

A:

B:

C:

VARIANTS OF YEAST NDI1 GENE, AND USES THEREOF IN THE TREATMENT OF DISEASE ASSOCIATED WITH MITOCHONDRIAL DYSFUNCTION

CROSS REFERENCE TO RELATED APPLICATIONS

This application is a 35 U.S.C. § 371 National Phase Entry Application of International Application No. PCT/EP2012/076697 filed Dec. 21, 2012, which designates the U.S., and which claims benefit under one or more of 35 U.S.C. § 119(a)-119(d) of European Application No. 11194796.6, filed Dec. 21, 2011, the content of which is incorporated herein by reference in its entirety.

SEQUENCE LISTING

The instant application contains a Sequence Listing which has been submitted in ASCII format via EFS-Web and is hereby incorporated by reference in its entirety. Said ASCII copy, created Nov. 30, 2016, is named Revised_SL_048262-082020-US.txt and is 2,223,693 bytes in size.

TECHNICAL FIELD

The invention relates to variants of yeast NDI1 gene, proteins encoded by the variants, and the uses of the variant genes, transcribed RNA and proteins in the treatment of disease, especially neurodegenerative disease.

INTRODUCTION

Leber hereditary optic neuropathy (LHON) is a maternally inherited disorder affecting 1/25,000 people, predominantly males1. Loss of central vision results from the degeneration of the retinal ganglion cell (RGC) layer and optic nerve2. In over 95% of patients the genetic pathogenesis of LHON involves mutations in genes encoding components of the mitochondrial respiratory NADH-ubiquinone oxidoreductase complex3 (complex I), which is involved in transfer of electrons from NADH to ubiquinone (coenzyme Q). Complex I is composed of forty-six subunits, seven of which are encoded by the mitochondrial genome, ND1-6 and ND4L. Mutations in five of the mitochondrially encoded subunits of complex I, ND1, ND4, ND4L, ND5 and ND6, are associated with LHON. There is growing evidence that mitochondrial dysfunction may be involved in a wide range of neurodegenerative disorders such as Alzheimer disease (AD), Huntington disease and dominant optic atrophy as well as multifactorial diseases including dry and wet age related macular degeneration (AMD), diabetic retinopathies and glaucoma4. It is perhaps not surprising that a tissue such as retina, with the most significant energy requirements of any mammalian tissues, may be particularly vulnerable to mitochondrial dysfunction. However, it is notable that such a dependency on energy metabolism in principle may provide an opportunity for the development of therapeutic interventions for such high energy-dependent tissues where a shift in energy metabolism may potentially provide substantial beneficial effects. Complex I dysfunction results in an increase of reactive oxygen species (ROS) and a decreased energy supply6. In mitochondria, ATP synthesis is coupled to oxygen consumption by the proton electrochemical gradient established across the mitochondrial inner membrane in the process termed oxidative phosphorylation7 (OXPHOS). Mitochondrial complex I mutations leading to respiratory chain dysfunction are hence linked to reduced oxygen consumption; a reliable measure of overall mitochondrial activity.

Interestingly, many LHON mutations are not fully penetrant, it seems that the appearance of the pathological features of the disorder may be influenced by genetic and environmental modifiers. For example, it has been observed that the T14484C mutation in the ND6 subunit tends to be associated with a better clinical outcome and at times recovery in visual function[8]. Furthermore, there has been some suggestion that certain mitochondrial genetic backgrounds may render patients more or less susceptible to a variety of disorders including LHON and that this may be linked to variations in oxygen consumption, the efficiency of electron transport and ATP production[9]. For example, the G11778A and T14484C LHON mutations on a mitochondrial haplogroup J or K background have been associated with an increased risk of visual loss[10]. Nuclear modifier genes can influence LHON progression and severity, for example, an x-linked modifier locus has been reported[11]. Additionally, smoking has been suggested as one of the environmental factors which can influence disease penetrance[12]. In addition, the male prevalence (5:1) of LHON may at last in part be influenced by oestrogens[13]. An interplay between the primary mutation, modifying nuclear genes, the mtDNA genetic background and environmental factors may collaborate to determine overall risk of visual loss for a given LHON patient.

While significant progress has been made with regard to understanding the genetic pathogenesis of LHON, development of gene therapies for LHON has been impeded by the need to deliver therapies to the mitochondria of RGCs. In addition, intragenic heterogeneity has made development of therapies complex. Allotopic or nuclear expression of mitochondrial genes is being explored as a potential therapeutic avenue for some mitochondrial disorders including ND4-linked LHON, although modifications may be required to facilitate import of expressed proteins into mitochondria[14, 15,16]. A nuclear complementation approach using NDI1 has been considered as a potential therapy for Parkinson disease (PD)[17]. Additionally, recombinant adenoassociated virus (AAV) serotype 5 delivery of NDI1 into the optic layer of the superior colliculus of the brain, has recently been shown to provide significant benefit in a chemically-induced rat model of LHON using functional and histological readouts[18]. Whereas this represents an exciting and innovative strategy making use of transkingdom gene therapy, the mode of delivery may not be readily translatable to human LHON patients.

It is an object of the invention to overcome at least one of the above-referenced problems.

STATEMENTS OF INVENTION

The invention relates to variants of the yeast NDI1 gene of SEQ ID NO: 1 which are codon optimised to provide for improved expression in mammalian cells, and/or modified to encode an immune optimised functional variant of NDI1 protein. Codon optimisation involves replacing codons which are common to yeast cells and uncommon to mammalian cells with synonymous codons which are common to mammalian cells. These are known as "silent changes" as they do not result in an amino acid change in the encoded protein. Codon optimisation provides for improved expression of the nucleic acid in mammalian cells and/or conveys less immunogenicity. Immune optimisation involves substitution of one or more amino acids (i.e. see Table 1b), for example from one to ten amino acids, in the protein to provide a variant protein that exhibits reduced immunogenicity in-vivo in humans compared to yeast NDI1 protein. Examples of possible amino acid changes include conservative amino acid changes at one or more of the following positions:

L195, K284, K10, S143, L502, L403, A387, S86, F90, L94, K196, L19, K214, K373, L259, K511, L159, R479, L483, I82, F90, L89, V266, K214, L481, L202, L259, L195, L150, R85, Y151, Y482, S488, V45, L483, S80, K196, for example one or more of the following amino acid changes:

L195F, K284E, K10R, S143N, L502M, L403I, A387S, S86K, F90H, L94M, K196E, L19M, K214E, K373E, L259F, K511E, L159M, R479Q, L483M, I82V, F90Y, L89I, V266I, K214E, L481I, L202M, L259V, L195I, L150M, R85K, Y151F, Y482F, S488T, V45I, L483M, S80T, K196T.

In a first aspect, the invention provides an isolated nucleic acid sequence encoding the yeast NDI1 protein of SEQ ID NO: 542 or a functional variant thereof having at least 90% sequence identity with SEQ ID NO: 542, wherein the nucleic acid comprises at least 50 codons which are codon optimised compared with the sequence of yeast NDI1 gene of SEQ ID NO: 1.

Examples of codon optimised variants of yeast NDI1 gene are provided in SEQ ID NO'S: 2-62, 75-145, 165-243, 264-341, 362-441, 462-541, and 705-1004.

In a second aspect, the invention provides an isolated codon optimised nucleic acid sequence encoding an immune optimised functional variant of the yeast NDI1 protein of SEQ ID NO: 542 comprising at least one conservative amino acid change at a residue selected from the group consisting of:

L195, K284, K10, S143, L502, L403, A387, S86, F90, L94, K196, L19, K214, K373, L259, K511, L159, R479, L483, I82, F90, L89, V266, K214, L481, L202, L259, L195, L150, R85, Y151, Y482, S488, V45, L483, S80, K196, for example one or more of the following amino acid changes:

L195F, K284E, K10R, S143N, L502M, L403I, A387S, S86K, F90H, L94M, K196E, L19M, K214E, K373E, L259F, K511E, L159M, R479Q, L483M, I82V, F90Y, L89I, V266I, K214E, L481I, L202M, L259V, L195I, L150M, R85K, Y151F, Y482F, S488T, V45I, L483M, S80T, K196T, wherein the nucleic acid comprises at least 50 codons which are codon optimised compared with the sequence of wild-type yeast NDI1 gene of SEQ ID NO: 1.

Examples of immune and codon optimised variants of yeast NDI1 gene are provided in SEQ ID NO'S: 75-145, 165-243, 264-341, 362-441, 462-541, 566-584, 705-824, 835-884, 895-944 and 955-1004.

In a third aspect, the invention provides an isolated nucleic acid sequence encoding an immune optimised functional variant of yeast NDI1 protein of SEQ ID NO: 542 in which the variant comprises at least one conservative amino acid change at a residue selected from the group consisting of:

L195, K284, K10, S143, L502, L403, A387, S86, F90, L94, K196, L19, K214, K373, L259, K511, L159, R479, L483, I82, F90, L89, V266, K214, L481, L202, L259, L195, L150, R85, Y151, Y482, S488, V45, L483, S80, K196, for example one or more of the following amino acid changes:

L195F, K284E, K10R, S143N, L502M, L403I, A387S, S86K, F90H, L94M, K196E, L19M, K214E, K373E, L259F, K511E, L159M, R479Q, L483M, I82V, F90Y, L89I, V266I, K214E, L481I, L202M, L259V, L195I, L150M, R85K, Y151F, Y482F, S488T, V45I, L483M, S80T, K196T.

In an additional aspect of the invention the NDI1 gene and encoded protein are immune optimized employing amino acid substitution(s) at one or more key NDI1 positions as defined by K10, L19, V45, S80, I82, R85, S86, L89, F90, L94, S143, L150, Y151, L159, L195, K196, L202, K214, L259, V266, K284, K373, A387, L403, R479, L481, Y482, L483, S488, L502, K511.

Examples of immune optimised variants of yeast NDI1 gene (without codon optimisation) are provided in SEQ ID NO'S: 63-74 and 547-565 (one amino acid change), 146-164 and 585-605 (two amino acid changes), 244-263 and 606-640 (three amino acid changes), 641-675 (four amino acid changes), 342-361 and 676-696 (five amino acid changes), 697-703 (six amino acid changes), 704 (seven amino acid changes) and 442-461 (ten amino acid changes).

Typically, the nucleic acid sequence of the invention encodes a functional variant of the yeast NDI1 protein of SEQ ID NO: 542 having at last 90% sequence identity with SEQ ID NO:542. Preferably, the functional variant comprises at least 91%, 92%, 93%, 94%, 95%, 96%, 97%, 98% or 99% sequence identity with SEQ ID NO: 542.

Preferably, the nucleic acid sequence of the invention encodes a yeast NDI1 protein that includes at least 1, 2, 3, 4, 5, 6, 7, 8, 9, or 10 amino acid changes. Typically, from 1-20, 1-15, or ideally from 1-10, amino acids are changed. The changes are suitably conservative changes made to one or more of the residues identified above, for example one or more of: L195F, K284E, K10R, S143N, L502M, L403I, A387S, S86K, F90H, L94M, K196E, L19M, K214E, K373E, L259F, K511E, L159M, R479Q, L483M, I82V, F90Y, L89I, V266I, K214E, L481I, L202M, L259V, L195I, L150M, R85K, Y151F, Y482F, S488T, V45I, L483M, S80T, K196T.

Preferably, the nucleic acid sequence of the invention encodes a yeast NDI1 protein that includes at least 2, 3, 4, 5, 6, 7, 8, 9, or 10 amino acid changes. Typically, from 1-20, 1-15, or ideally from 1-10, amino acids are changed, and the changes are suitably selected at NDI1 positions from the group: K10, L19, V45, S80, I82, R85, S86, L89, F90, L94, S143, L150, Y151, L159, L195, K196, L202, K214, L259, V266, K284, K373, A387, L403, R479, L481, Y482, L483, S488, L502, K511.

Suitably, the variant protein includes at least 1, 2, 3, 4, 5, 6, 7, 8, 9, 10, 11, 12, 13, 14, 15, 16, 17, 18, or all of the amino acid changes selected from: L195F, K284E, K10R, S143N, L502M, L403I, A387S, S86K, F90H, L94M, K196E, L19M, K214E, K373E, L259F, K511E, L159M, R479Q, L483M, I82V, F90Y, L89I, V266I, K214E, L481I, L202M, L259V, L195I, L150M, R85K, Y151F, Y482F, S488T, V45I, L483M, S80T, K196T.

Ideally, the variant protein includes an amino acid change selected from: L195F, K284E, K10R, S143N, L502M, L403I, A387S, S86K, F90H, L94M, K196E, L19M, K214E, K373E, L259F, K511E, L159M, R479Q, L483M, I82V, F90Y, L89I, V266I, K214E, L481I, L202M, L259V, L195I, L150M, R85K, Y151F, Y482F, S488T, V45I, L483M, S80T, K196T.

Preferably, at least 90, 100, 150, 200, 250, 300, 320, or 329 codons are codon optimised for use in a mammal. In one embodiment, 1-100, 100-200, 200-300, or 300-329 codons are optimised. Ideally, 329 codons are optimised (see SEQ ID NO's 62, 134-145, 225-243, 324-341, 422-441, 522-541, 566-584 and 705-824).

In another embodiment 1-100, 100-200, 200-300, or 300-329 NDI1 codons are optimised for use in mammals and the nucleic acid sequence encodes a yeast NDI1 protein that includes at least 1, 2, 3, 4, 5, 6, 7, 8, 9, or 10 amino acid changes. Typically, from 1-20, 1-15, or ideally from 1-10, amino acids are changed, and the changes are suitably selected at NDI1 positions from the group: K10, L19, V45, S80, I82, R85, S86, L89, F90, L94, S143, L150, Y151, L159, L195, K196, L202, K214, L259, V266, K284, K373, A387, L403, R479, L481, Y482, L483, S488, L502, K511.

Preferably, the nucleic acid of the invention encodes a variant protein having at least 91%, 92%, 93%, 94%, 95%, 96%, 97%, 98% or 99% sequence identity with SEQ ID NO: 542.

The invention also relates to a nucleic acid construct comprising a nucleic acid sequence of the invention and a nucleic acid sequence encoding a mitochondrial localisation sequence. This may be, but are not limited to, sequences such as MLSKNLYSNKRLLTSTNTLVRFASTRS (SEQ ID NO: 1006) or MSVLTPLLLRGLTGSARRLPVPRAKIHSL (SEQ ID NO: 1007).

The invention also relates to a nucleic acid construct encoding a protein of the invention. The nucleic acid may be a DNA or RNA nucleic acid. The nucleic acid of the invention may use modified nucleic acids to optimise delivery and or increase stability and or increase longevity and or reduce immunogenicity 22,23.

In one aspect the invention relates to delivery of RNA encoding the protein and or protein variants of the invention.

The invention also relates to a protein encoded by a nucleic acid construct of the invention.

The term "nucleic acid sequence of the invention" as employed hereafter should be understood to mean either or both of the nucleic acid sequences of the invention and the nucleic acid constructs of the invention.

The invention also relates to a nucleic acid sequence selected from SEQ ID NO's: 1-541 and 547-1004.

The invention also relates to a protein encoded by a nucleic acid sequence of the invention. The protein may also include one or more mitochondrial localisation signal(s). This may be but not limited to sequences such as MLSKNLYSNKRLLTSTNTLVRFASTRS (SEQ ID NO: 1006) or MSVLTPLLLRGLTGSARRLPVPRAKIHSL (SEQ ID NO: 1007).

The invention also relates to a vector suitable for use in gene therapy and comprising a nucleic acid sequence of the invention. Suitably the vector is a viral vector, typically an adeno-associated virus (AAV), preferably AAV virus serotype 2, although other AAV serotypes and other types of vectors may be employed such as for example other viral vectors, non-viral vectors, naked DNA and other vectors, examples of which are listed in Table 5. Typically, the nucleic acid of the invention is expressed singly from the vector (single delivery vehicle). In another embodiment, the nucleic acid of the invention is expressed together with another gene either from the single delivery vehicle or using two delivery vehicles, for example, a gene that enhances cell survival and or cell function such as a neurotrophic factor, a growth factor, an anti-apoptotic agent, an antioxidant, a cytokine, a hormone or others, examples of which are described in Table 6. Genes may be delivered at the same time and/or before and/or after each other. Ideally, the second gene is a neurotrophic factor, examples of which are described in Table 6.

The invention also relates to a kit comprising a vector of the invention in combination with a second vector comprising a gene that enhances cell survival and or cell function such as a neurotrophic factor, a growth factor, an anti-apoptotic agent, an antioxidant, a cytokine, a hormone or others, examples of which are described in Table 6. Ideally, the second vector comprises a gene encoding a neurotrophic factor.

In an additional aspect additional gene sequences may be expressed in the same vector as the nucleic acid of the invention from a component such as an internal ribosome entry site (IRES) and or may be expressed using two or multiple promoter sequences.

Typically, the vector of the invention comprises a promotor wherein the nucleic acid of the invention is expressed from the promotor. Preferably, the promotor is one that is preferentially or specifically expressed in retinal ganglion cells (RGC's) wherein expression of the nucleic acid of the invention is under the control of the promotor. Examples of such promotors are described in Table 4. In an alternative embodiment, the vector of the invention comprises a promotor known to be expressed at low levels in RGC's.

In a further embodiment, the promotor is one that is known to be expressed in multiple cell types, examples of which are described in Table 4.

In an additional aspect, the nucleic acid of the invention is expressed from an inducible and/or conditional promotor.

In a further embodiment, the promotor is a tissue specific and/or cell specific promotor targeting mammalian cells other than RGC's such as the rhodopsin promotor which expresses in rod photoreceptor cells. Suitably, the vector comprises tissue specific and/or cell specific promotors combined with an inducible promotor system to control expression of the nucleic acid.

The promotors may control expression of the nucleic acid of the invention in combination with additional genes, as described above. Alternatively, the vector may comprise different promotors for expressing the nucleic acid of the invention and the other genes, for example, a gene encoding a neurotrophic agent.

The invention also relates to a method for the treatment and/or prevention of a neurodegenerative disease, especially LHON, which method comprises a step of delivering a nucleic acid of the invention to an individual by means of intraocular, ideally intravitreal, delivery. In one aspect a nucleic acid of the invention is delivered to an individual by means of systemic administration.

Preferably, the step of delivering the nucleic acid of the invention involves delivering a vector of the invention to the individual.

The invention also relates to the use of a nucleic acid of the invention, or a protein encoded by a nucleic acid of the invention, or a vector of the invention, as a medicament.

The invention also relates to a nucleic acid sequence of the invention, or a protein encoded by a nucleic acid sequence of the invention, or a vector of the invention, for use in the treatment of a disease or condition associated with mitochondrial dysfunction, for example a neurodegenerative disease, especially Leber Hereditary Optic Neuropathy (LHON). Typically, the treatment is symptomatic or prophylactic treatment.

The invention also relates to a method of treating a disease, for example a disease associated with mitochondrial dysfunction, for example a neurodegenerative disease, in an individual comprising a step of administering an active agent to the individual, typically administering the active agent to the eye, ideally to the retinal ganglion cells, photoreceptor cells or other eye cells, in which the active agent includes a nucleic acid sequence of the invention, a protein encoded by the nucleic acid sequence of the invention, or a vector of the invention. The treatment may be symptomatic or prophylactic treatment.

Typically, the active agent is administered by intra-ocular, ideally intra-vitreal and/or subretinal, administration. The active agent may include an additional agent, for example a gene or protein or compounds that enhances cell survival and or cell function such as a neurotrophic factor, a growth factor, an anti-apoptotic agent, an antioxidant, a cytokine, a hormone or others, examples of which are described in Table 6. The active agent and the additional agent, for example an additional gene, may be delivered at the same time or before or after each other.

Ideally, the additional agent is a gene encoding a neurotrophic factor, examples of which are described in Table 6. The active agent may be delivered by means of a vector, or by means of separate vectors, or by direct delivery of the additional agent. The active agent may be delivered to other parts of the body involving mitochondrial dysfunction, for example, to the brain for the treatment of neurodegenerative diseases such as Alzheimer's disease, Parkinson's disease or dementia, or to photoreceptor cells for the treatment of Retinitis Pigmentosa or Age-related macular degeneration, or to muscle cells to treat muscle weakness and/or degeneration.

Further, the nucleic acid sequence of the invention, its protein product, or a vector of the invention, may be delivered to the target cell or tissue at the same time or at a different time to the additional agent.

The invention also relates to a cell, for example a stem cell or progenitor cell, RGC or RGC precursor cell that is transformed with a nucleic acid of the invention. Cells of the invention may be delivered to the eye via subretinal and/or intravitreal injection to treat cells of the eye affected by mitochondrial dysfunction such as RGC dysfunction. Alternatively, cells of the invention may be delivered to other parts of the body involving mitochondrial dysfunction, for example to the brain for the treatment of neurodegenerative diseases such as Alzheimer disease, Parkinsons disease or dementia, or to photoreceptor cells for the treatment of Retinitis Pigmentosa or Age-related macular degeneration, or to muscle cells to treat muscle weakness and/or degeneration.

Thus, the invention also relates to a transformed cell of the invention for use as a medicament. The invention also relates to a method of treating a disease or condition involving mitochondrial dysfunction, typically a neurodegenerative disease, suitably LHON, comprising a step of delivering cells of the invention to the individual.

The invention also provides a pharmaceutical formulation comprising an active agent selected from a nucleic acid of the invention, a protein encoded by the nucleic acid of the invention, a vector of the invention, or a cell of the invention, in combination with a pharmaceutically acceptable carrier.

Suitably, the formulation is provided in the form of a slow release capsule adapted to release the active agent following subretinal and or intravitreal injection, or following delivery to or close to a target tissue type/cell type (see examples in Table 7).

In an additional embodiment encapsulated cell technology is employed for delivery of the therapy.

In one embodiment the invention provides a transgenic organ, or a transgenic non-human animal, comprising the nucleic acids and vectors of the invention.

In another embodiment the invention may be delivered to cells with mutations in the nuclear genome which lead to disease phenotypes which are similar to disease phenotypes related to mitochondrial mutations. For example the disease phenotypes described in Table 8 may all result from nuclear mutations or mitochondrial mutations and hence may benefit from the invention. The invention would need to be delivered to the appropriate affected cell or tissue type. Typically these nuclear mutations affect cell types that require high levels of energy such as neurons and muscle cells. Hence these disorders, resulting from mutations in the nuclear genome and affecting these high energy requiring cell types may also benefit from additional energy provided by the invention.

In a further aspect, the invention relates to a method for the treatment or prevention of a neurodegenerative disease, especially LHON, which method comprises a step of delivering a yeast NDI1 gene, or a variant thereof such as a nucleic acid of the invention, to an individual by means of intraocular delivery, ideally intravitreal and/or subretinal delivery.

In a yet further aspect, the invention relates to a method for the treatment or prevention of a neurodegenerative disease, especially LHON, which method comprises a step of delivering a yeast NDI1 gene, or a variant thereof such as a nucleic acid of the invention, and an agent that enhances cell survival and or cell function such as a neurotrophic factor, a growth factor, an anti-apoptotic agent, an antioxidant, a cytokine, a hormone or others (examples of which are described in Table 6) to an individual. Treatment may be symptomatic or prophylactic.

In a yet further aspect, the invention relates to a method for the treatment or prevention of a neurodegenerative disease, especially LHON, which method comprises a step of delivering a yeast NDI1 gene, or a variant thereof such as a nucleic acid of the invention using an AAV vector, and delivery of an agent, using the same or a separate AAV vector, that enhances cell survival and or cell function such as a neurotrophic factor, a growth factor, an anti-apoptotic agent, an antioxidant, a cytokine, a hormone or others (examples of which are described in Table 6) to an individual. Treatment may be symptomatic or prophylactic.

The term "yeast NDI1 gene" refers to the wild-type *Saccharomyces cerviscae* NDI1 gene shown in SEQ ID NO: 1.

The term "variant of yeast NDI1 gene" means a variant of yeast NDI1 gene which differs from the wild-type gene due to at least codon optimisation, immune optimisation, or both.

The term "conservative amino acid change" should to be understood to mean that the amino acid being introduced is similar structurally, chemically, or functionally to that being substituted. In particular, it refers to the substitution of an amino acid of a particular grouping as defined by its side chain with a different amino acid from the same grouping.

The term nucleic acid means deoxyribonucleic acid (DNA), ribonucleic acid (RNA), and artificial nucleic acid analogs such as peptide nucleic acid (PNA), morpholino- and locked nucleic acid, glycol nucleic acid and threose nucleic acid. Artificial nucleic acid analogs differ from DNA and RNA as they typically contain changes to the backbone of the molecule. Nucleic acids incorporating chemical modification(s) to DNA and RNA to optimise delivery and or increase stability and or increase longevity and or reduce immunogenicity are also contemplated by the term nucleic acid. Modifications, such as phosphorothioates, boranophosphate, 2'-Amino, 2'-Fluoro, 2'-Methoxy have been made to nucleic acids to modulate parameters such as resistance to nuclease degradation, binding affinity and or uptake. Exemplary nucleic acid molecules for use are phosphoramidate, phosphothioate and methylphosphonate analogs of DNA and or RNA. Modifications include but are not limited to inclusion of 5-fluorouracil, 5-bromouracil, 5-chlorouracil, 5-iodouracil, hypoxanthine, xantine, 4-acetylcytosine, 5-(carboxyhydroxymethyl)uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 2'-O-methyl, 5-methyl-2-thiouracil, 2-thiouracil, 4-thiouracil, 5-methyluracil, uracil-5-oxyacetic acid methylester, uracil-5-oxyacetic acid (v), -5-methyl-2-thiouracil, 3-(3-amino-3-N-2-carboxypropyl)uracil, (acp3)w, and 2,6-diaminopurine, 2-thiourdine, 5-methyl-cytidine amongst others.

The term "codon optimised" means that a codon that expresses a bias for yeast (i.e. is common in yeast genes but uncommon in mammalian genes) is changed to a synonomous codon (a codon that codes for the same amino acid) that expresses a bias for mammals. Thus, the change in codon does not result in any amino acid change in the encoded protein.

The term "immune optimised" as applied to a variant of yeast NDI1 gene means that the gene variant encodes a variant NDI1 protein which elicits a reduced immune response when expressed in a mammal compared to the wild-type yeast NDI1 gene.

The term "yeast NDI1 protein" should be understood to mean the wild-type *Saccharomyces cerviscae* NDI1 protein shown in SEQ ID NO: 542. The "functional variant" should be understood to mean a variant of SEQ ID NO: 542 which retains the functionality of yeast NDI1 protein, for example, comparable oxygen consumption measurements in the presence of rotenone (see methods below/FIG. 2). Typically, the functional variants of yeast NDI1 protein will have at least 90%, 91%, 92%, 93%, 94%, 95%, 96%, 97%, 98% or 99% sequence identity with SEQ ID NO: 542. In this context, a polypeptide sequence that shares 90% amino acid identity with SEQ ID NO: 542 is one in which any 90% of aligned residues are either identical to, or conservative substitutions of, the corresponding residues in SEQ ID NO: 542. The "percent sequence identity" of two amino acid sequences is determined using the algorithm of Karlin and Altschul *Proc. Natl. Acad. Sci.* USA 87:2264-68, 1990, modified as in Karlin and Altschul *Proc. Natl. Acad. Sci.* USA 90:5873-77, 1993. Such an algorithm is incorporated into the NBLAST and XBLAST programs (version 2.0) of Altschul, et al. *J. Mol. Biol.* 215:403-10, 1990. BLAST protein searches can be performed with the XBLAST program, score=50, wordlength=3 to obtain amino acid sequences homologous to the protein molecules of the invention. Where gaps exist between two sequences, Gapped BLAST can be utilized as described in Altschul et al., *Nucleic Acids Res.* 25(17):3389-3402, 1997. When utilizing BLAST and Gapped BLAST programs, the default parameters of the respective programs (e.g., XBLAST and NBLAST) can be used.

The term "neurodegenerative disease" should be understood to mean a disease characterised by neuronal injury or death, or axonal degeneration, and includes diseases such as motor neuron disease; prion disease; Huntington's disease; Parkinson's disease; Parkinson's plus; Tauopathies; Chromosome 17 dementias; Alzheimer's disease; Multiple sclerosis (MS); hereditary and acquired neuropathies; retinopathies and diseases involving cerebellar degeneration.

In the context of the present invention, the term "gene therapy" refers to treatment of individual which involves insertion of a gene into an individual's cells for the purpose of preventing or treating disease. Insertion of the gene is generally achieved using a delivery vehicle, also known as a vector. Viral and non-viral vectors may be employed to deliver a gene to a patients' cells. Other types of vectors suitable for use in gene therapy are described below.

The term "neurotrophic agent" should be understood to mean a protein that induces the survival, development and function of neurons. Examples include nerve growth factor (NGF) and brain-derived neurotrophic factor (BDNF). Other examples are provided below.

Retinal ganglion cells (RGCs) are types of neurons located close to the inner surface (the retinal ganglion layer) of the retina of the eye. They collectively image forming and non-image forming visual information from the retina to several regions in the thalamus, hypothalamus, and midbrain.

It will be appreciated that the nucleci acids of the invention may include one or more polyadenylation signals, typically located at the 3'-end of the molecule. In addition, the nucleic acid may include a leader sequence and/or a stop codon. It will also be appreciated that the nucleci acids of the invention may include one or more signals to facilitate import of proteins into mitochondria.

Proteins and polypeptides (including variants and fragments thereof) of and for use in the invention may be generated wholly or partly by chemical synthesis or by expression from nucleic acid. The proteins and peptides of and for use in the present invention can be readily prepared according to well-established, standard liquid or, preferably, solid-phase peptide synthesis methods known in the art (see, for example, J. M. Stewart and J. D. Young, Solid Phase Peptide Synthesis, 2nd edition, Pierce Chemical Company, Rockford, Ill. (1984), in M. Bodanzsky and A. Bodanzsky, The Practice of Peptide Synthesis, Springer Verlag, New York (1984).

Apart from the specific delivery systems embodied below, various delivery systems are known and can be used to administer the therapeutic of the invention, e.g., encapsulation in liposomes, microparticles, microcapsules, recombinant cells capable of expressing the Therapeutic, receptor-mediated endocytosis (see, e.g., Wu and Wu, 1987, J. Biol. Chem. 262:4429-4432), construction of a therapeutic nucleic acid as part of a retroviral or other vector, etc. Methods of introduction include but are not limited to intradermal, intramuscular, intraperitoneal, intraocular, intravenous, subcutaneous, intranasal, epidural, and oral routes. The compounds may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. In addition, it may be desirable to introduce the pharmaceutical compositions of the invention into the central nervous system by any suitable route, including intraventricular and intrathecal injection; intraventricular injection may be facilitated by an intraventricular catheter, for example, attached to a reservoir, such as an Ommaya reservoir. Pulmonary administration can also be employed, e.g., by use of an inhaler or nebulizer, and formulation with an aerosolizing agent. In addition, naked DNA can be used for delivery.

In one aspect of the invention, agents such as surfactants may be included in formulations to minimize aggregation of the therapeutic of the invention, whether viral and/or non-viral vectors, proteins or polypeptides and/or cells.

In a specific embodiment, it may be desirable to administer the pharmaceutical compositions of the invention locally to the area in need of treatment; this may be achieved, for example, by means of an implant, said implant being of a porous, non-porous, or gelatinous material, including membranes, such as sialastic membranes, or fibers.

In another embodiment, the therapeutic can be delivered in a vesicle, in particular a liposome (see Langer, Science 249:1527-1533 (1990); Treat et al., in Liposomes in the Therapy of Infectious Disease and Cancer, Lopez-Berestein and Fidler (eds.), Liss, New York, pp. 353-365 (1989); Lopez-Berestein, ibid., pp. 317-327; see generally ibid.)

In yet another embodiment, the therapeutic can be delivered in a controlled release system. In one embodiment, a pump may be used (see Langer, supra; Sefton, CRC Crit. Ref. Biomed., Eng. 14:201 (1987); Buchwald et al., Surgery 88:75 (1980); Saudek et al., N. Engl. J. Med. 321:574 (1989)). In another embodiment, polymeric materials can be used (see Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, J. Macromol. Sci. Rev. Macromol. Chem. 23:61 (1983); see also Levy et al., Science 228:190 (1985); During et al., Ann. Neurol. 25:351 (1989); Howard et al., J. Neurosurg. 71:105 (1989)). In yet another embodiment, a controlled release system can be placed in proximity of the therapeutic target, thus requiring only a fraction of the systemic dose (see, e.g., Goodson, in Medical Applications of Controlled Release, supra, vol. 2, pp. 115-138 (1984)). Other controlled release systems are discussed in the review by Langer (Science 249:1527-1533 (1990)).

The present invention also provides pharmaceutical compositions comprising a nucleic acid of the invention and/or a protein encoded by the nucleic acid. Such compositions comprise a therapeutically effective amount of the therapeutic, and a pharmaceutically acceptable carrier. In a specific embodiment, the term "pharmaceutically acceptable" means approved by a regulatory agency of the Federal or a state government or listed in the U.S. Pharmacopeia or other generally recognized pharmacopeia for use in animals, and humans. The term "carrier" refers to a diluent, adjuvant, excipient, or vehicle with which the therapeutic is administered. Such pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene glycol, water, ethanol and the like.

The composition, if desired, can also contain minor amounts of wetting or emulsifying agents, or pH buffering agents. These compositions can take the form of solutions, suspensions, emulsion, tablets, pills, capsules, powders, sustained-release formulations and the like. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc. Examples of suitable pharmaceutical carriers are described in "Remington's Pharmaceutical Sciences" by E. W. Martin. Such compositions will contain a therapeutically effective amount of the therapeutic, preferably in purified form, together with a suitable amount of carrier so as to provide the form for proper administration to the patient.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocaine to, ease pain at the, site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

The amount of the therapeutic of the invention which will be effective in the treatment of a particular disorder or condition will depend on the nature of the disorder or condition, and can be determined by standard clinical techniques. In addition, in vivo and/or in vitro assays may optionally be employed to help predict optimal dosage ranges. The precise dose to be employed in the formulation will also depend on the route of administration, and the seriousness of the disease or disorder, and should be decided according to the judgment of the practitioner and each patient's circumstances.

Nucleic Acid Sequences of the Invention

The sequence listing below provides a number of nucleic acid sequences according to the invention, specifically:

SEQ ID NO: 1—Yeast NDI1 gene—0 amino acid changes—0 codon changes

SEQ ID NO'S 2-21 and 825-834—Yeast NDI1 gene—0 amino acid changes—100 codon changes SEQ ID NO'S 22-41 and 885-894—Yeast NDI1 gene—0 amino acid changes—200 codon changes SEQ ID NO'S 42-61 and 945-954—Yeast NDI1 gene—0 amino acid changes—300 codon changes SEQ ID NO 62—Yeast NDI1 gene—0 amino acid changes—329 codon changes SEQ ID NO'S 63-74 and 547-565—Yeast NDI1 gene—1 amino acid changes—0 codon changes SEQ ID NO'S 75-94 and 835-844—Yeast NDI1 gene—1 amino acid changes—100 codon changes SEQ ID NO'S 95-114 and 895-904—Yeast NDI1 gene—1 amino acid changes—200 codon changes SEQ ID NO'S 115-134 and 955-964—Yeast NDI1 gene—1 amino acid changes—300 codon changes SEQ ID NO'S 134-145 and 566-584—Yeast NDI1 gene—1 amino acid changes—329 codon changes SEQ ID NO'S 146-164 and 585-605—Yeast NDI1 gene—2 amino acid changes—0 codon changes SEQ ID NO'S 165-184 and 845-854—Yeast NDI1 gene—2 amino acid changes—100 codon changes SEQ ID NO'S 185-204 and 905-914—Yeast NDI1 gene—2 amino acid changes—200 codon changes SEQ ID NO'S 205-224 and 965-974—Yeast NDI1 gene—2 amino acid changes—300 codon changes SEQ ID NO'S 225-243 and 705-725—Yeast NDI1 gene—2 amino acid changes—329 codon changes SEQ ID NO'S 244-263 and 606-640—Yeast NDI1 gene—3 amino acid changes—0 codon changes SEQ ID NO'S 264-283 and 855-864—Yeast NDI1 gene—3 amino acid changes—100 codon changes SEQ ID NO'S 284-303 and 915-924—Yeast NDI1 gene—3 amino acid changes—200 codon changes SEQ ID NO'S 304-323 and 975-984—Yeast NDI1 gene—3 amino acid changes—300 codon changes SEQ ID NO'S 324-341 and 726-760—Yeast NDI1 gene—3 amino acid changes—329 codon changes SEQ ID NO'S 641-675—Yeast NDI1 gene—4 amino acid changes—0 codon changes SEQ ID NO'S 865-874—Yeast NDI1 gene—4 amino acid changes—100 codon changes SEQ ID NO'S 925-934—Yeast NDI1 gene—4 amino acid changes—200 codon changes SEQ ID NO'S 985-994—Yeast NDI1 gene—4 amino acid changes—300 codon changes SEQ ID NO'S 761-795—Yeast NDI1 gene—4 amino acid changes—329 codon changes SEQ ID NO'S 342-361 and 676-696—Yeast NDI1 gene—5 amino acid changes—0 codon changes SEQ ID NO'S 362-381 and 875-884—Yeast NDI1 gene—5 amino acid changes—100 codon changes SEQ ID NO'S 382-401 and 935-944—Yeast NDI1 gene—5 amino acid changes—200 codon changes SEQ ID NO'S 402-421 and 995-1004—Yeast NDI1 gene—5 amino acid changes—300 codon changes SEQ ID NO'S 422-441 and 796-816—Yeast NDI1 gene—5 amino acid changes—329 codon changes SEQ ID NO'S 697-703—Yeast NDI1 gene—6 amino acid changes—0 codon changes SEQ ID NO'S 817-823—Yeast NDI1 gene—6 amino acid changes—329 codon changes SEQ ID NO 704—Yeast NDI1 gene—7 amino acid changes—0 codon changes SEQ ID NO 824—Yeast NDI1 gene—7 amino acid changes—329 codon changes SEQ ID NO'S 442-461—Yeast NDI1 gene—10 amino acid changes—0 codon changes SEQ ID NO'S 462-481—Yeast NDI1 gene—10 amino acid changes—100 codon changes SEQ ID NO'S 482-501—Yeast NDI1 gene—10 amino acid changes—200 codon changes SEQ ID NO'S 502-521—Yeast NDI1 gene—10 amino acid changes—300 codon changes SEQ ID NO'S 522-541—Yeast NDI1 gene—10 amino acid changes—329 codon changes SEQ ID NO: 542—Yeast NDI1 protein—0 amino acid changes

Notably OphNDI1 may contain 0-10 amino acid substitutions to modulate and immune response or 1-329 altered codons, which are expressed more frequently in mammalian cells than the wild type codons in NDI1 (Table 1a & 1b and Sequence Listing). In addition the CMV and ubiquitin promoters may be substituted for any of the promoters indicated in Tables 2-4 and the GDNF gene may be substituted for any gene indicated in Table 6. Sequences for these core construct designs are presented in Table 1a & 1b and the attached Sequence Listing. Notably, different polyadenalation signals may also be utilised in the constructs described.

Figure 2:
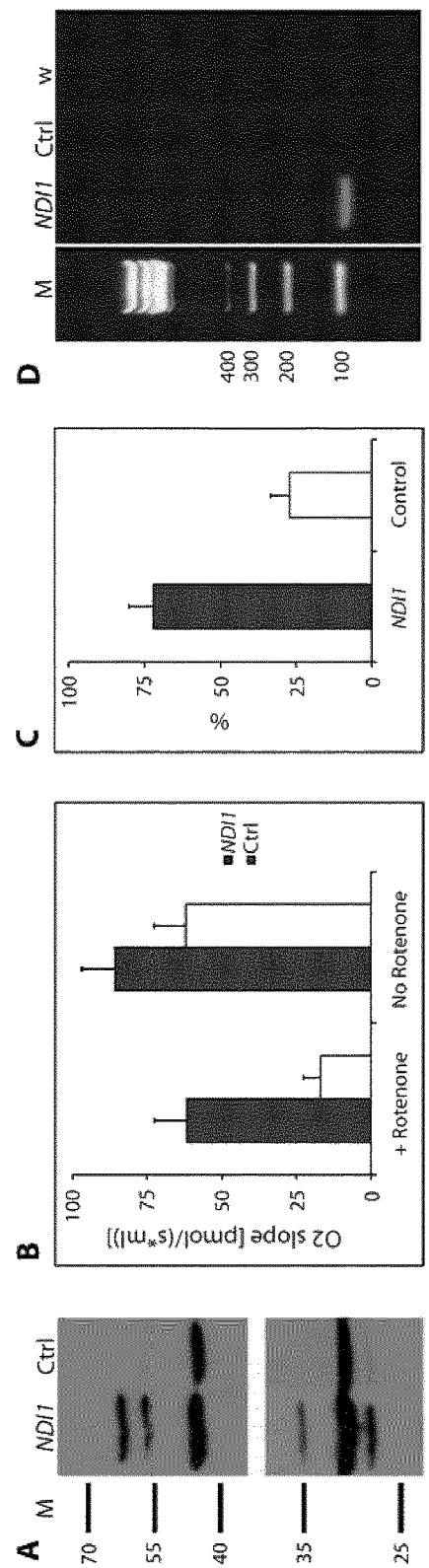

FIG. 2. Localisation, function and mRNA expression of NDI1. Western blot analysis of mitochondrial protein isolated from pAAV-NDI1 transfected and untransfected (Ctrl) HeLa cells (A). Top panel shows NDI1 protein expression (56 KDa) and bottom panel shows VDAC1 protein expression (31 KDa, mitochondrial loading control; n=3). B. Bar chart represents oxygen consumption measurements from pAAV-NDI1 transfected (black columns) and pAAV-EGFP transfected (Ctrl, white columns) HeLa cells with (+) and without (no) 5 µmol rotenone (n=6). C. Bar chart represents percentage rotenone insensitive respiration in pAAV-NDI1 transfected (black columns) and pAAV-EGFP transfected (control, white columns) HeLa cells (n=6). D. Retinal NDI1 mRNA expression from adult wild type mice intravitreally injected with $3\times10^8$ vp AAV-NDI1 or $3\times10^8$ vp AAV-EGFP (Ctrl) and analysed by RT-PCR two weeks post-injection (n=6). Rot insensitive resp (%): Percentage rotenone insensitive respiration, w: water blank, M: size marker; KDa (A), by (D). Error bars represent SD values and *: p<0.001.

Figure 3:
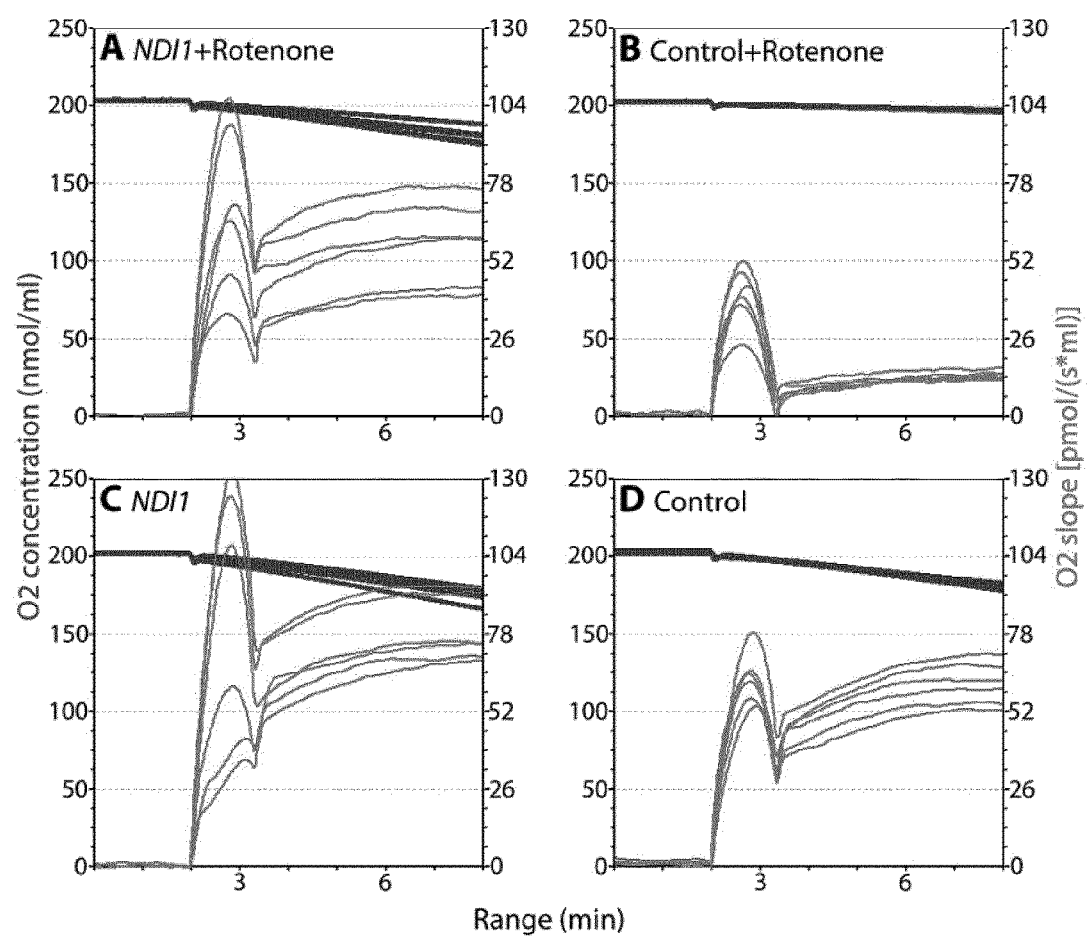

FIG. 3. Oxygen consumption measurements from NDI1 transfected HeLa cells. Oxygen consumption measurements from HeLa cells transfected with pAAV-NDI1 (A) and pAAV-EGFP (B) in the presence of 5 µmol rotenone. Oxygen consumption measurements from HeLa cells transfected with pAAV-NDI1 (C) and pAAV-EGFP (D) in the absence of rotenone (control).

Figure 4A:
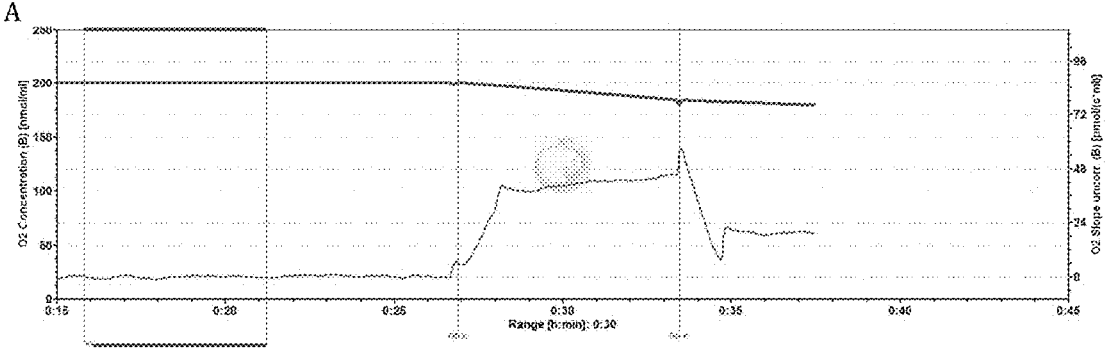
Figure 4A:
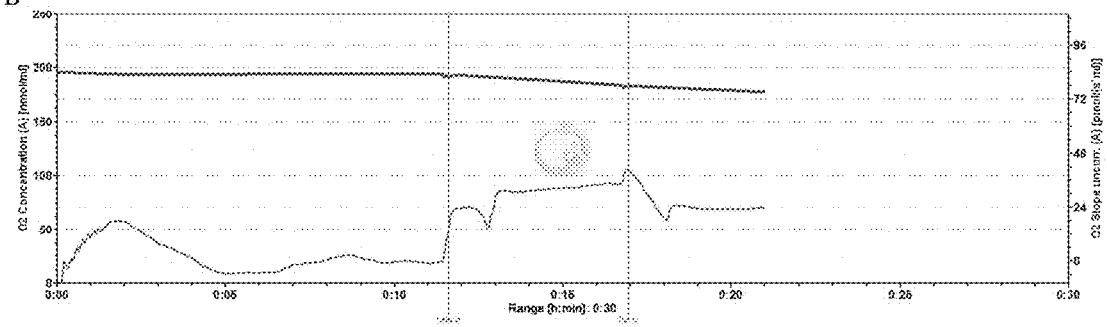
Figure 4A:
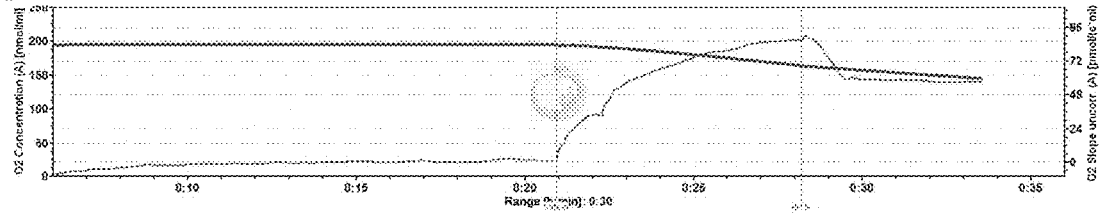
Figure 4A:
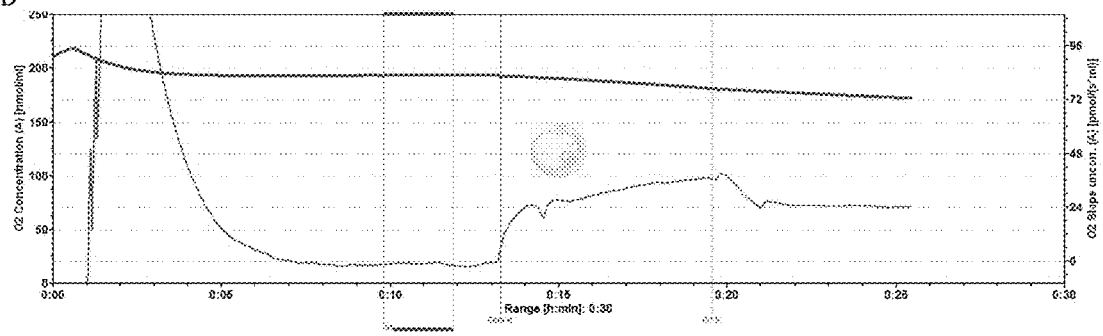
Figure 4A:
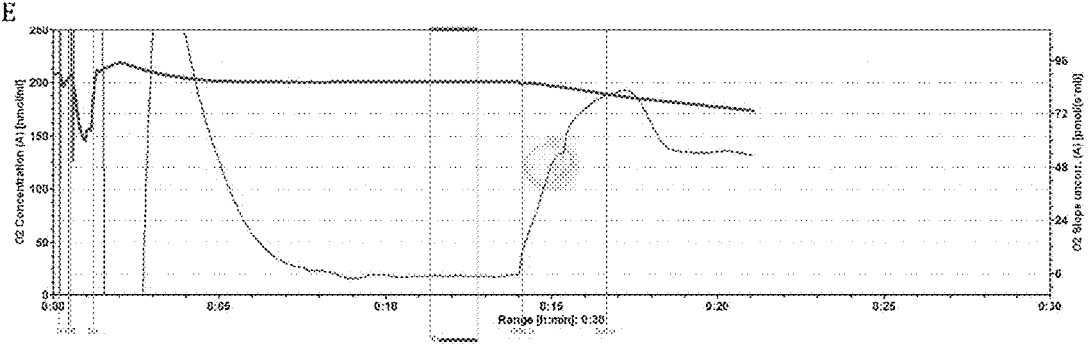
Figure 4A:
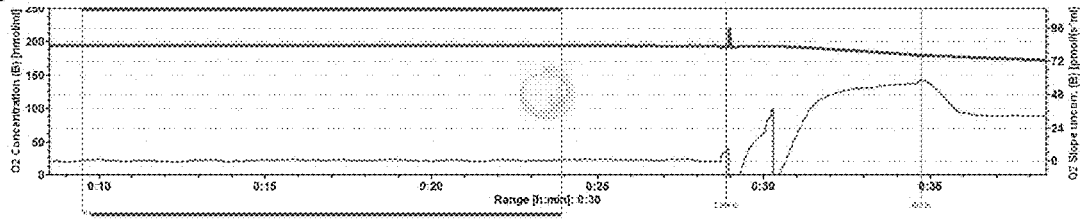
Figure 4A:
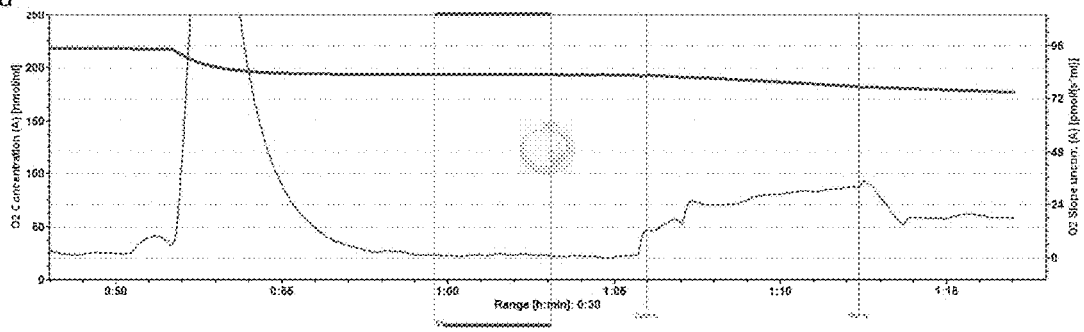
Figure 4A:
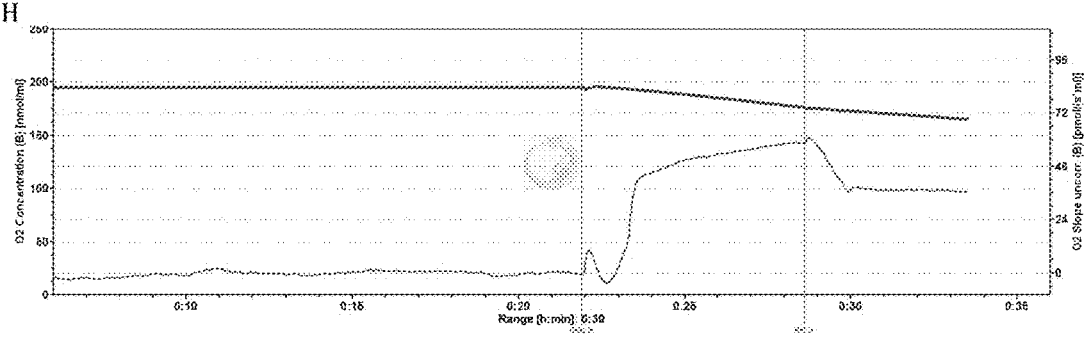
Figure 4A:
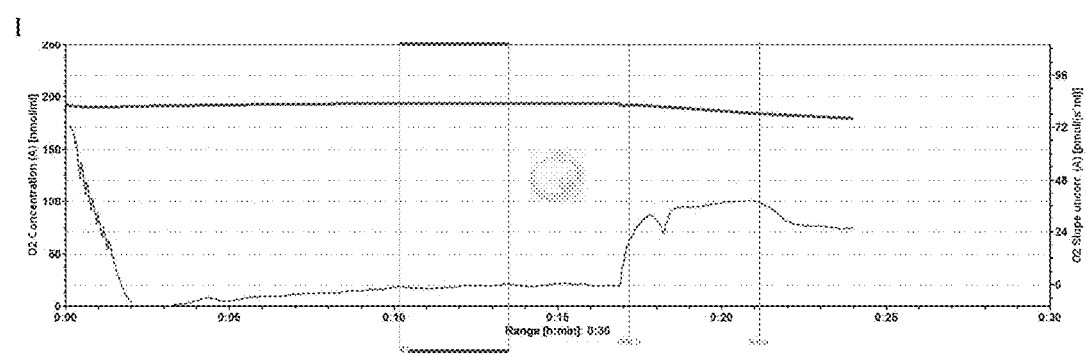

FIG. 4a. Oxygraphs for NDI1 constructs. Traces showing oxygen concentration (blue line) and oxygen consumption (red line) in media treated with 5 µmol rotenone and untransfected HeLa cells (negative control, A), cells transfected with ophNDI1-I82V (B), containing codon-optimisation at 329 codons and the I82V substitution and cells transfected with NDI1-I82V (C). Representative graphs for each are presented. Similarly HeLa cells were transfected with V45I constructs either the codon optimised hNDI1-V45I construct (D) or the wild type NDI1 construct containing the V45I substitution (NDI1-V45I; E). In addition V266I constructs, both NDI1-V266I (F) and hNDI1-V266I (G) were evaluated. The NDI1-F90Y (H) and hNDI1-F90Y (I) construct was also tested in HeLa cells treated with rotenone.

Figure 4B:
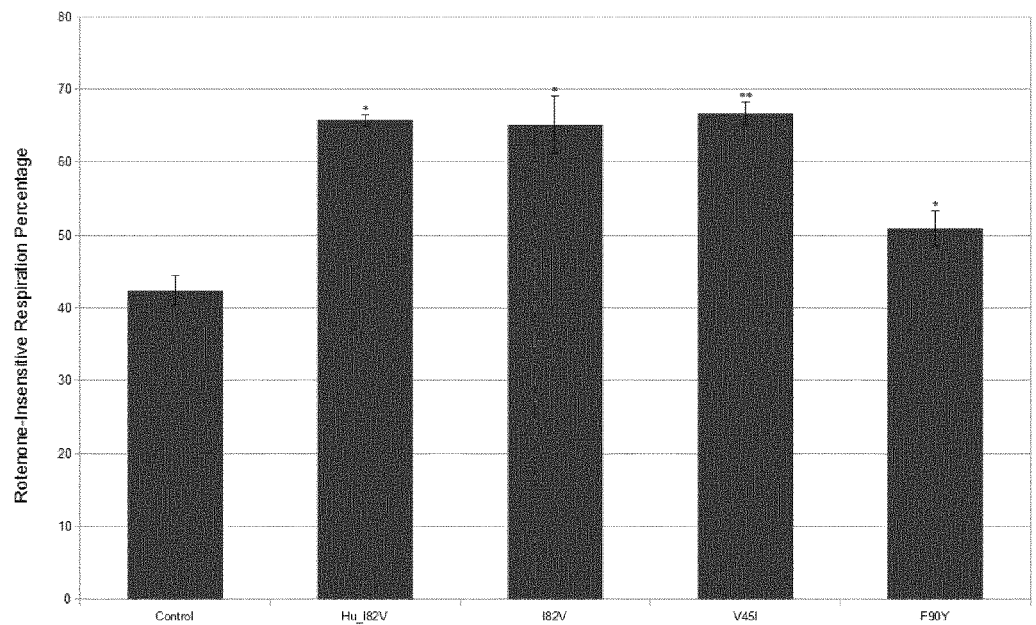

FIG. 4b. Bar charts of the data sets measuring the change in oxygen consumption from the experiments in FIG. 4a are presented. A statistically significant retention in oxygen consumption was observed between cells transfected with either the NDI1 variant or the hNDI1 variant constructs with p values ranging from p<0.05 (*) to <0.01 (**). A significant difference was observed between the rotenone insensitive respiration achieved with I82V and V45I constructs versus that achieved with the F90Y construct (I82V versus F90Y p<0.02 and V45I versus Y90Y p<0.002). No significant differences were observed between NDI1 treated cells and cells treated with NDI1-I82V, hNDI1-I82V or V45I constructs. However F90Y transfected cells differed significantly compared to NDI1 transfected cells, the latter showing a better retention of oxygen consumption.

Figure 5:
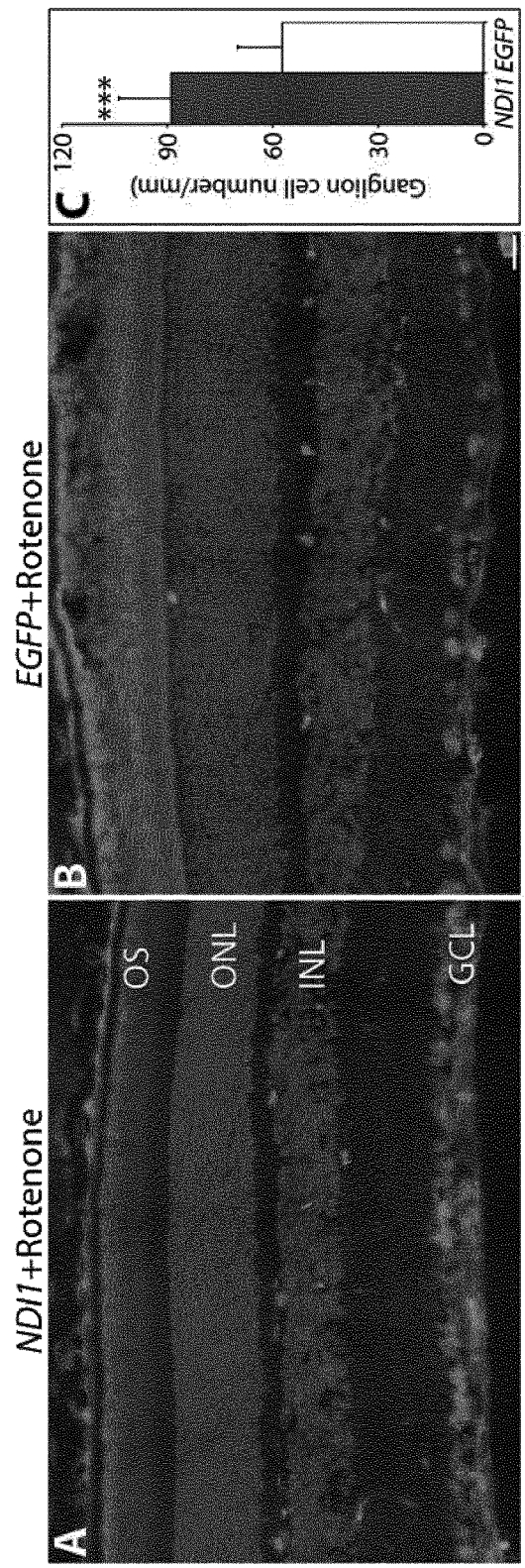

FIG. 5. Histology of NDI1 treated retinas following rotenone insult. Adult wild type mice were intravitreally injected into contralateral eyes with $3 \times 10^8$ vp AAV-NDI1 (A) and $1 \times 10^8$ vp AAV-EGFP, to facilitate localisation of transduced regions of the retinas, or $3 \times 10^8$ vp AAV-EGFP (B) alone (n=4). Three weeks post-injection, 1.5 nmol of rotenone was administered intravitrally to both eyes. Three weeks post-rotenone treatment eyes were enucleated, fixed, cryosectioned (12 μm) and processed for immunocytochemistry using NeuN primary and Cy3-conjugated secondary antibodies. Nuclei were counterstained with DAPI. A and B: representative sections show NeuN labelling (red) and nuclear DAPI (blue) signals overlaid. OS: photoreceptor outer segments; ONL: outer nuclear layer; INL: inner nuclear layer; GCL: ganglion cell layer. Scale bar: 20 μm. C: Bar chart representing mean ganglion cell counts per 100 μm. Blue and white columns represent values corresponding to AAV-NDI1+rotenone (NDI1) and AAV-EGFP+rotenone (EGFP), respectively. Error bars represent SD values and ***: $p<0.001$.

Figure 6:
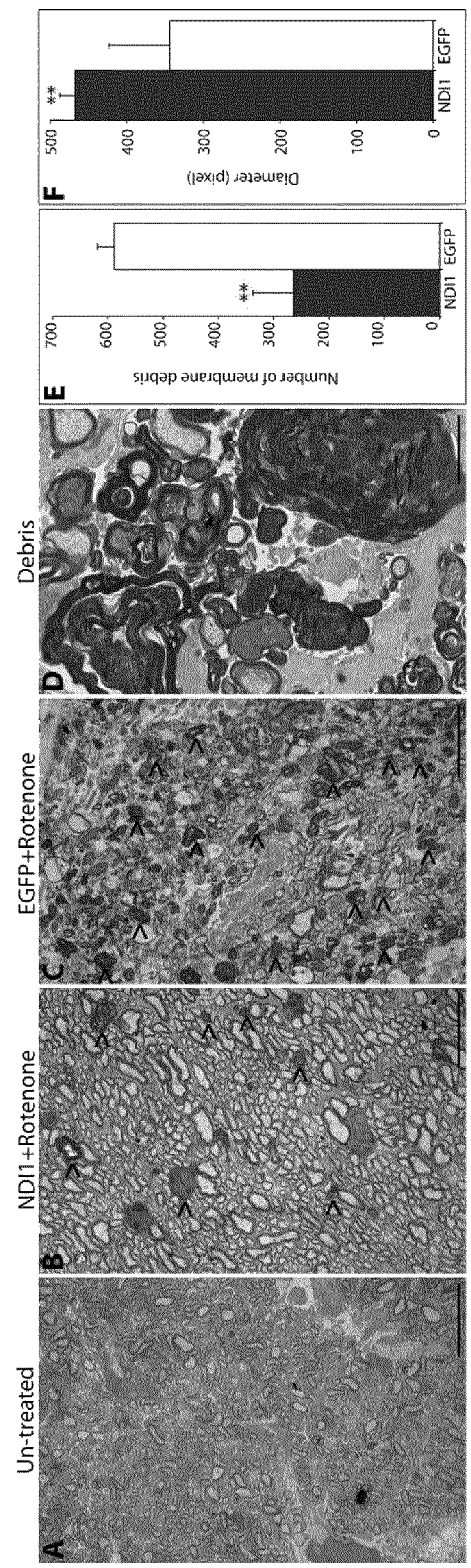

FIG. 6. Ultra-structural analysis of NDI1 treated optic nerves following rotenone insult. Adult wild type mice were intravitrally injected into contralateral eyes with AAV-NDI1 (B) or AAV-EGFP (C and D) (n=3). Three weeks post-injection, 1.5 nmol of rotenone was administered intravitreally to both eyes. Three weeks later eyes were enucleated and optic nerves collected, post-fixed, processed and analysed by transmission electron microscopy. At low magnification electron dense structures (arrow heads, B and C) were less frequent in the AAV-NDI1+rotenone (B) treated samples compared to the AAV-EGFP+rotenone treated samples (C). AAV-EGFP+rotenone treated samples at higher magnification (D). These were not apparent in the untreated samples (A). E: Bar chart representing mean number of membrane debris. Black and white columns represent AAV-NDI1+rotenone (NDI1) and AAV-EGFP+rotenone (EGFP), respectively. F: Bar chart representing mean optic nerve diameter measurements. Optic nerves from identically injected mice were taken nine months post-rotenone treatment, fixed, cryosectioned (12 μm) and the thickness of the optic nerve measured using light microscopy. Black and white columns represent AAV-NDI1+rotenone (NDI1) and AAV-EGFP+rotenone (EGFP), respectively. Error bars represent SD values and **: $p<0.01$. Scale bars: 10 μm (A, B and C) and 2 μm (D).

Figure 7:
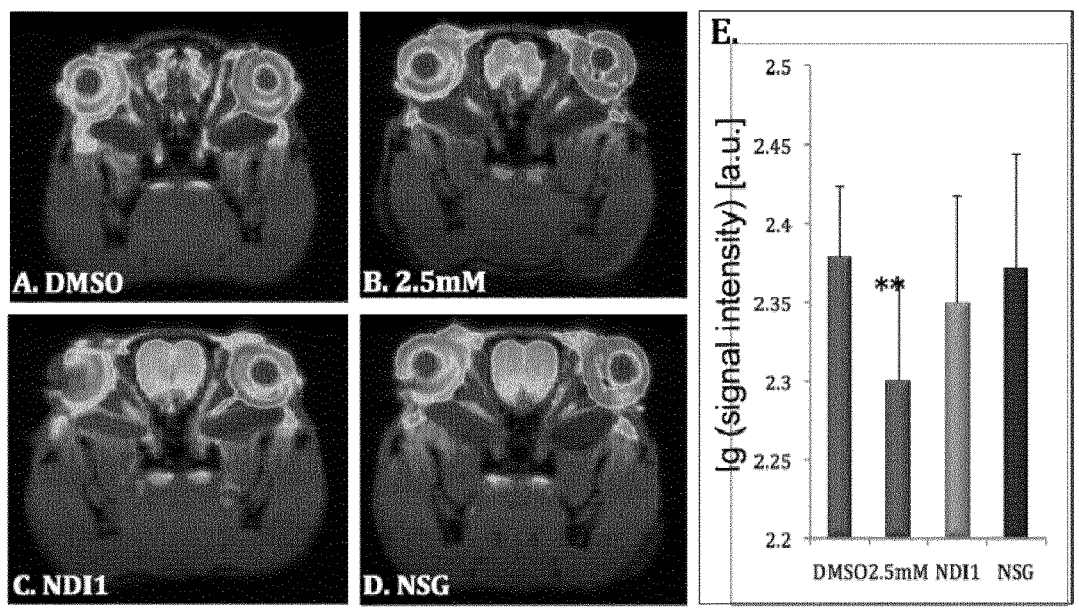

FIG. 7. Functional analysis of AAV-NDI1 and AAV-NSG treated optic nerves following rotenone insult. Adult wild type mice were intravitreally injected into the right eye with AAV-NDI1 (n=10) or AAV-NSG (n=6). Three weeks later, AAV-NDI1 (n=10) or AAV-NSG (n=6) injected mice received 1.5 nmol rotenone in the right eye. A further group of adult wild type mice received either DMSO (vehicle control, n=16) or 1.5 nmol rotenone intravitreally injected into the right eye (n=16). Two weeks post rotenone, or DMSO, treatment each mouse was intravitreally injected with 40 μg manganese chloride and manganese enhanced magnetic resonance imaging (MEMRI) carried out 2 hrs later. Pseudo-coloured T1-weighted images: Signal enhancement of the mouse visual pathway in oblique sections (36°) from DMSO (A), rotenone alone (B), AAV-NDI1+rotenone (C) and AAV-NSG+rotenone (D) are presented. E: Bar chart representing mean lg signal intensities in the region of the optic chiasm calculated using Image J® software. a.u.: arbitrary unit. Error bars represent SD values and ** represent $p<0.01$.

Figure 8:
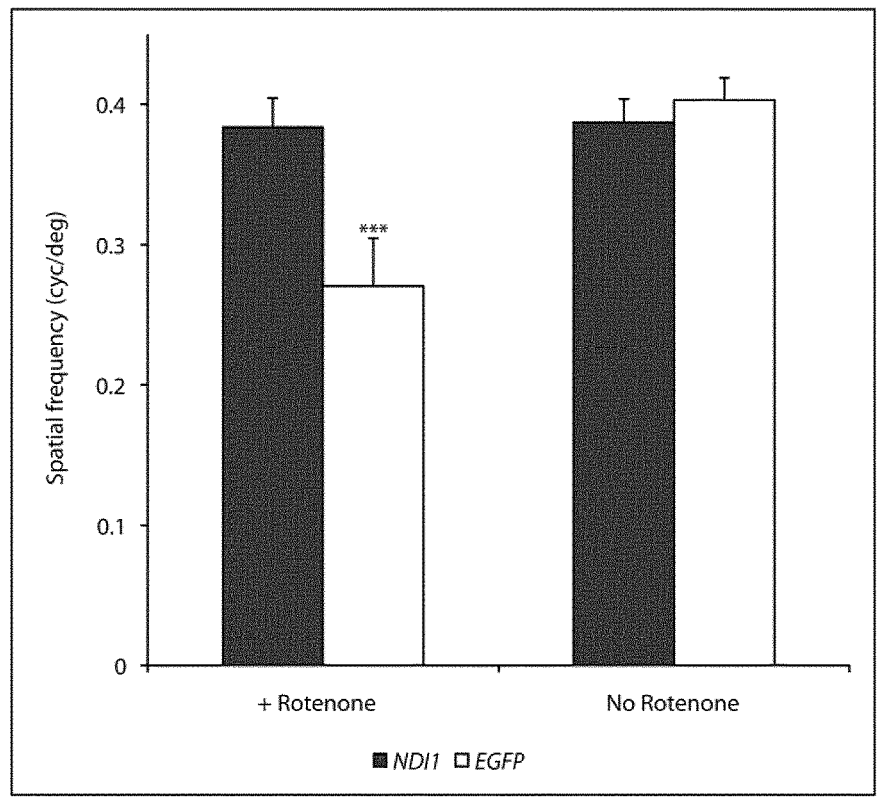

FIG. 8. Analysis of spatial vision in NDI treated mice following rotenone insult. Adult wild type mice were intravitrally injected into contralateral eyes with $3 \times 10^9$ vp AAV-NDI1 or $3 \times 10^9$ vp AAV-EGFP. Three weeks post-injection, 1.5 nmol of rotenone was administered intravitreally to both eyes; control mice were not administered with rotenone. Three months post-rotenone treatment optokinetic responses were measured using a virtual optokinetic system. Bar chart represents the mean spatial frequency threshold established for each eye. Black and white columns represent values corresponding to AAV-NDI1+rotenone (NDI1) and AAV-EGFP+rotenone (EGFP), respectively in rotenone treated (+Rotenone) and control (No Rotenone) mice. Error bars represent SD values and ***: $p<0.001$.

Figure 9A:
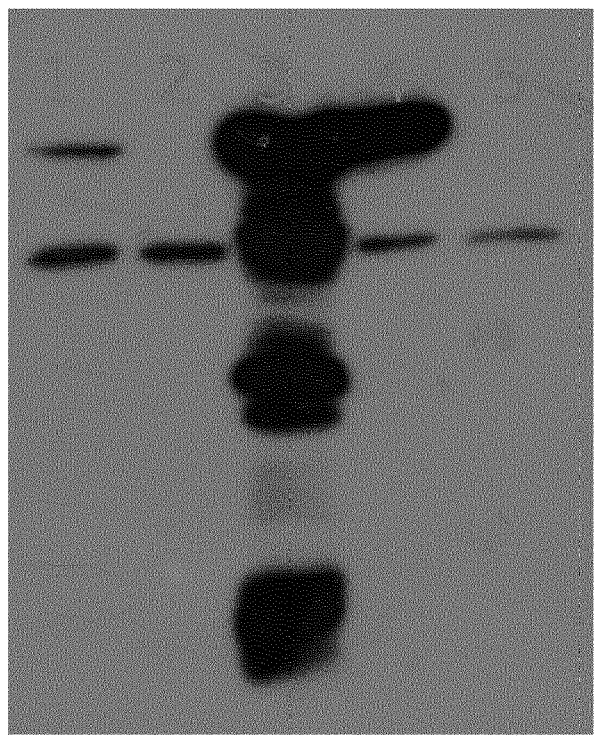

FIG. 9a. A representative western blot of proteins extracted from HeLa cells transiently transfected with plasmids expressing OphNDI1 and NDI1. A polyclonal antibody for Ndi1 was used to detect OphNDI1 and Ndi1 protein expressed in transfected cells. Lane 1; Ndi1 protein expressed from the original wild type NDI1 construct, Lane 2; Ndi1 with a C-terminal HA tag, Lane 3; Ndi1 protein expressed from OphNDI1, a humanized NDI1 construct with 329 optimised codons, Lane 4; Ndi1 protein expressed from OphNDI1-HA, a humanized Ndi1 with a HA tag. Lane 5; untransfected HeLa cells.

Figure 9B:
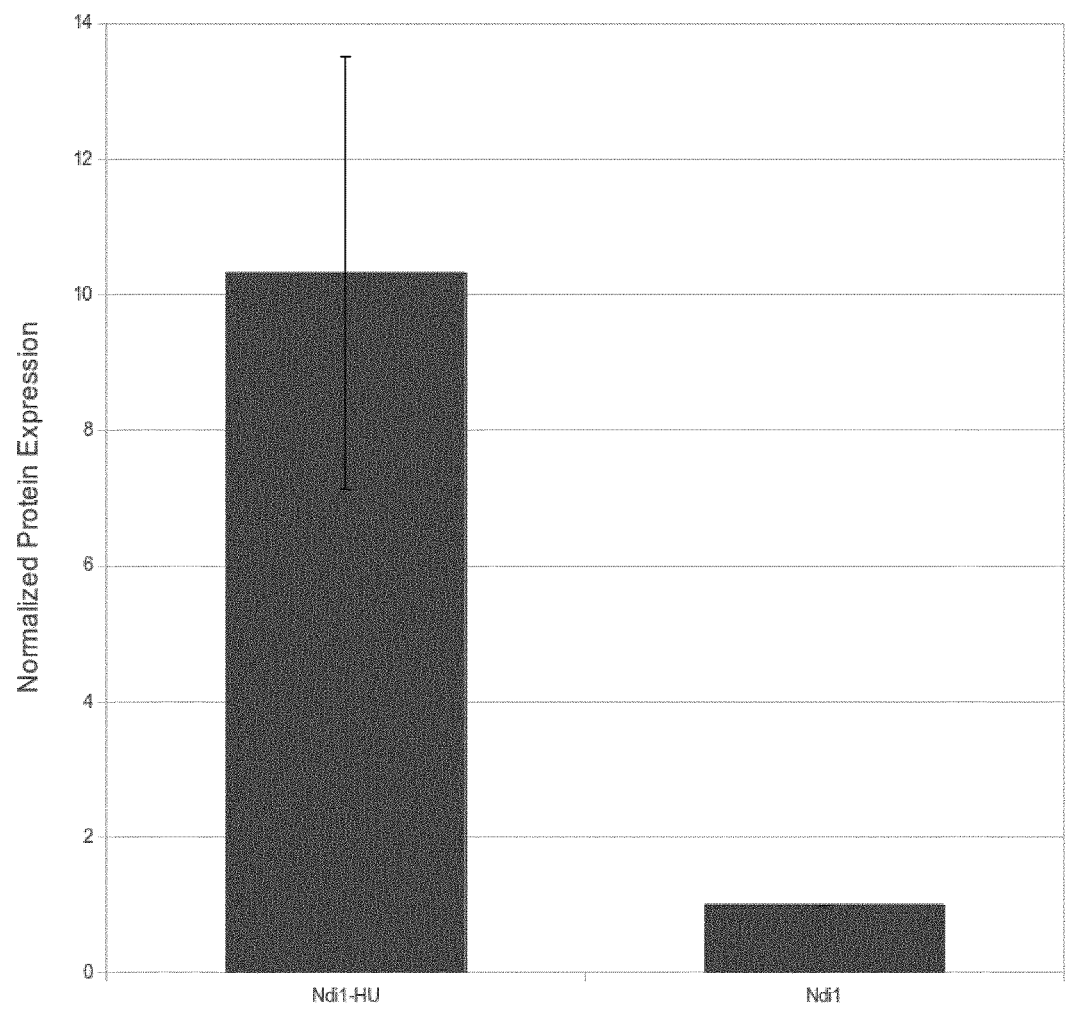

FIG. 9b: Bar chart showing normalized expression of humanized and wild-type Ndi1 protein as measured by western blot. HeLa cells were transfected with humanized and wild-type Ndi1. Cells were harvested 48 hours post-transfection and protein was extracted and western blotted using a polyclonal anti-Ndi1 primary antibody. Four independent blots were performed and images were captured and analysed with ImageJ® software to measure relative expression. For each blot, the relative expression level of wild-type Ndi1 was taken as a reference and the expression level of humanized Ndi1 was directly compared to it. Paired t-test performed on the non-normalized values indicate that humanized Ndi1 expresses significantly more highly than wild-typeNdI1 ($P<0.005$). a.u.:arbitrary unit FIG. 10. Expression from AAV vectors expressing variants of NDI1 AAV vectors were intravitreally injected into wild type mice. AAV vectors contained unmodified NDI1, NSG (expressing both unmodified NDI1 and a GDNF gene), modified NDI1 with a V266I modification, humanised NDI1 (hNDI1), or hNDI1 with a I82V modification. Two weeks post-injection retinas were harvested and total RNA extracted. Real time RT PCRs were performed on RNA samples using primers NDI1F and NDI1R and hNDI1F and hNDI1 R.

A, Levels of NDI1 expressed from unmodified vector (NDI1) and from NSG, which expresses both an unmodified NDI1 gene and a GDNF gene, were compared by real time RT-PCR. Levels of expression (y-axis) are expressed in copy number per unit of the housekeeping gene, β-actin.

B, Levels of humanised NDI1 (hNDI1) expressed in mouse retina delivered invitreally using AAV2/2 vectors were compared to levels of unmodified NDI1 delivered also using AAV2/2. Levels of expression are expressed in copy number per unit of the housekeeping gene β-actin. As expression levels in FIGS. 5A and 5B are expressed in copy number per unit of the housekeeping gene β-actin, expression levels may be compared directly.

C, RT-PCR samples performed on RNA samples extracted from wild type mice which were intravitreally injected with AAV2/2 vectors expressing variants of the NDI1 gene and run on 3% agarose gels. Lanes 1 and 8, GeneRuler 100 bp DNA size ladder (Fermentas). The two lower bands of the ladder represent 100 and 200 bp. Lane 2, NDI1; Lane 3, NSG; Lane 4, NDI1 with V266I modification; Lane 5, NSG; Lane 6, humanised NDI1; Lane 7 Humanised NDI1 with I82V modification. NDI1 amplification product is 87 bp and humanised NDI1 amplification product is 115 bp. Equal amounts of PCR products were loaded into each well. The hNDI1 and NSG vectors resulted in visibly higher levels of expression than the unmodified NDI1 vector mirroring the findings in FIGS. 10a and 10b.

Figure 11A:
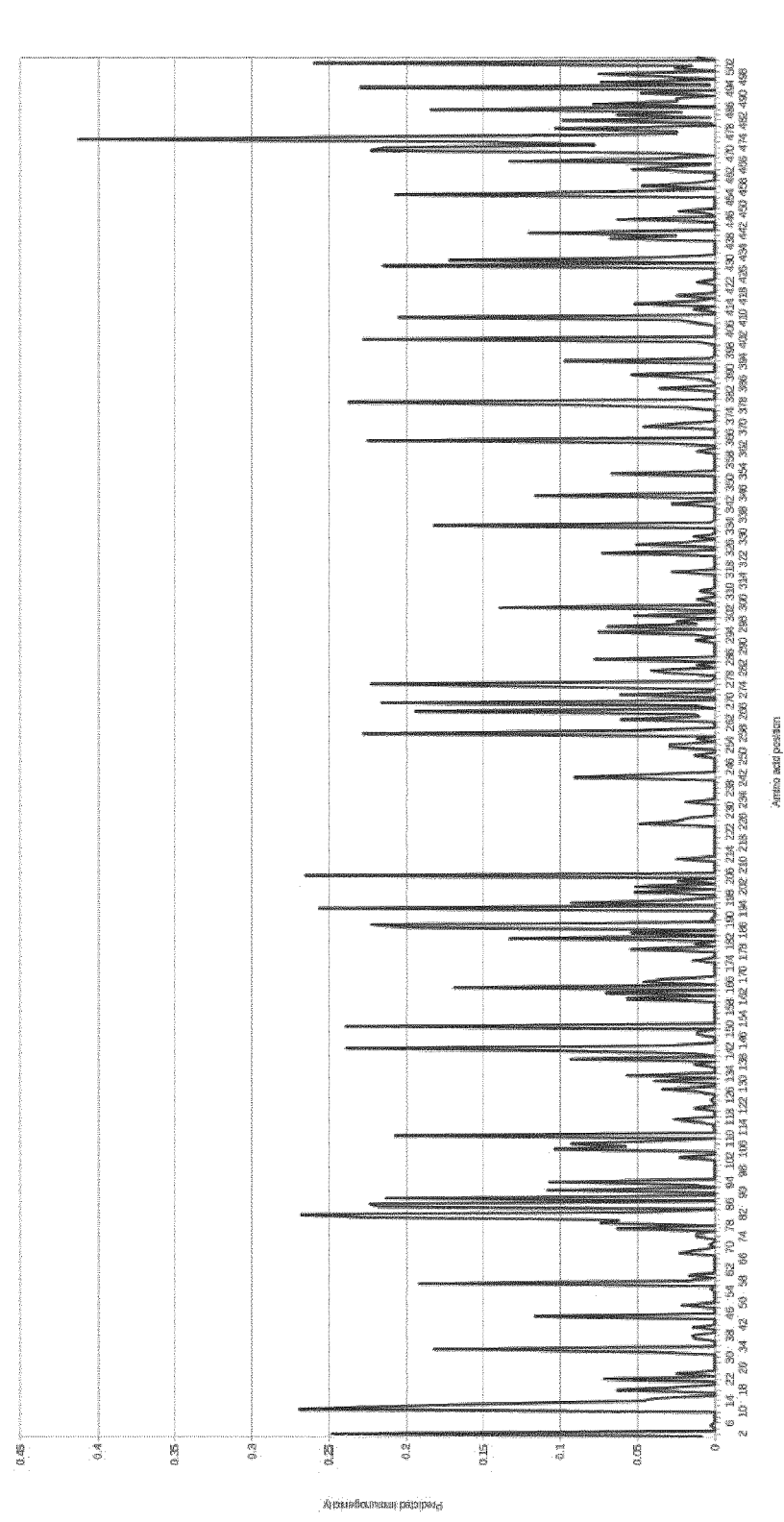
Figure 11B:
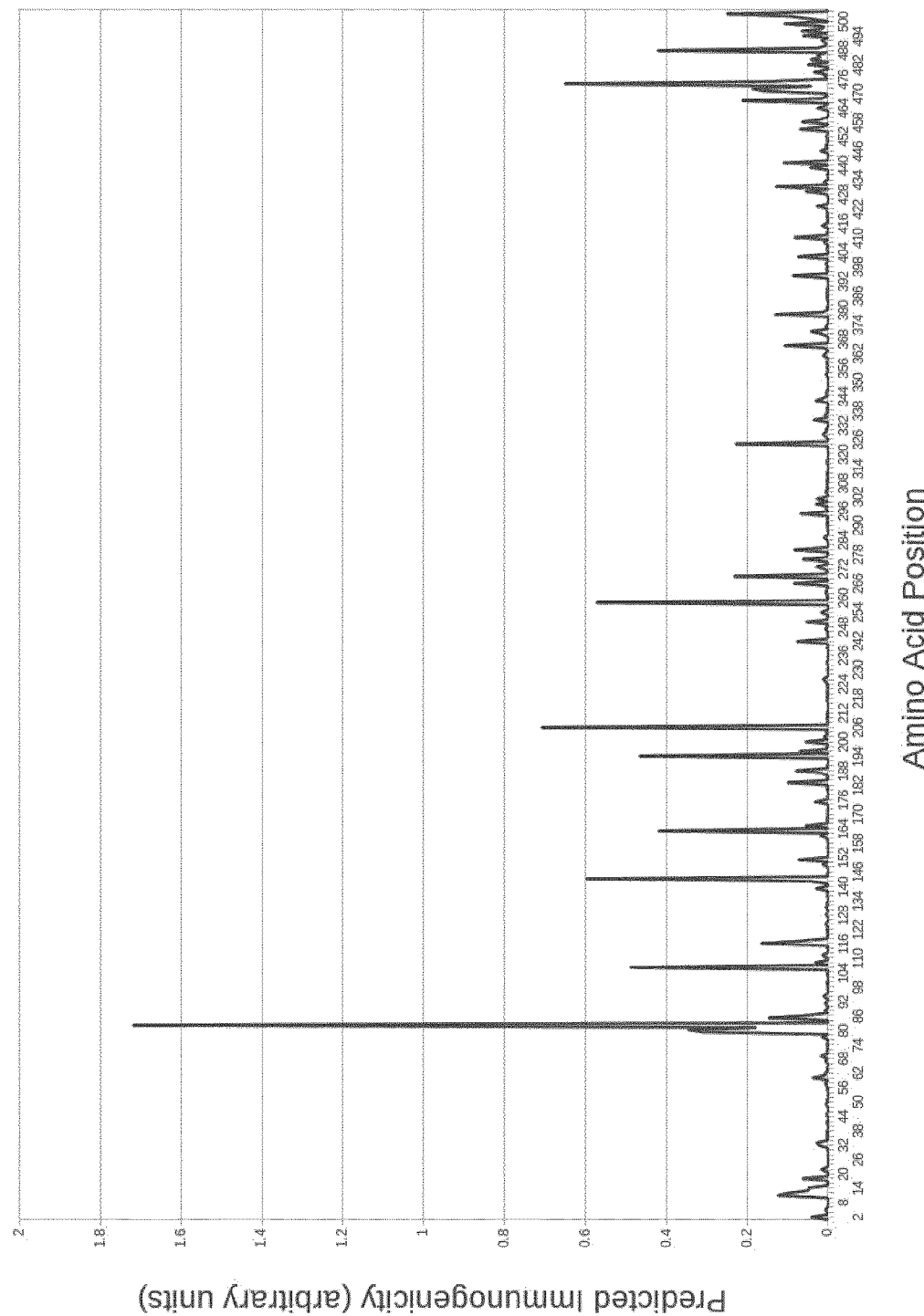

FIG. 11. Immunogenicity predictions of each 9-mer peptide fragment in NDI1, via in silico modelling of antigen presentation using the MHC class I predictor alone (FIG. 11a) or employing the MHC-I pathway using the IEDB proteasomal cleavage/TAP transport/MHC class I combined predictor (FIG. 11b). Immunogenicity scores and amino acid positions are presented.

Figure 12A:
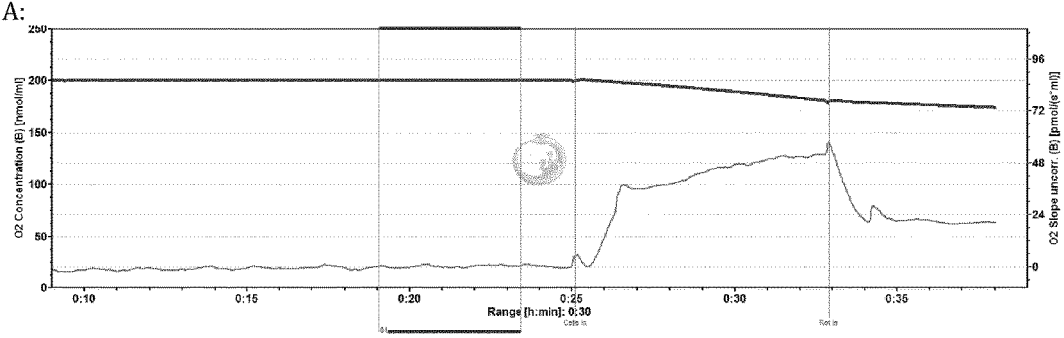
Figure 12A:
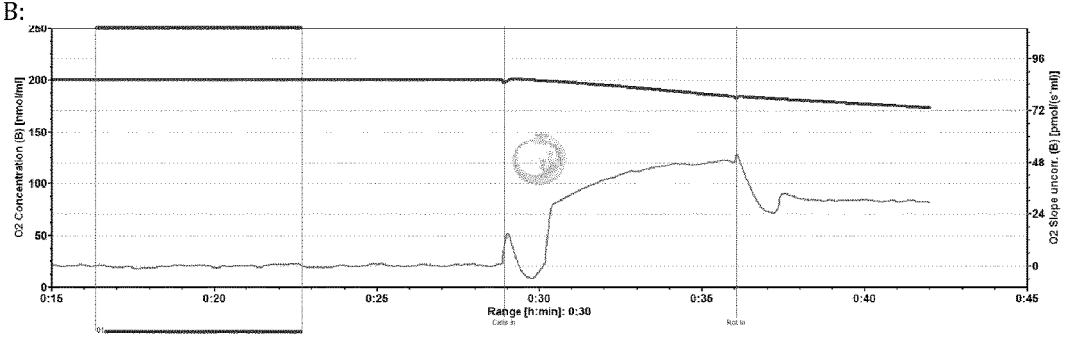
Figure 12A:
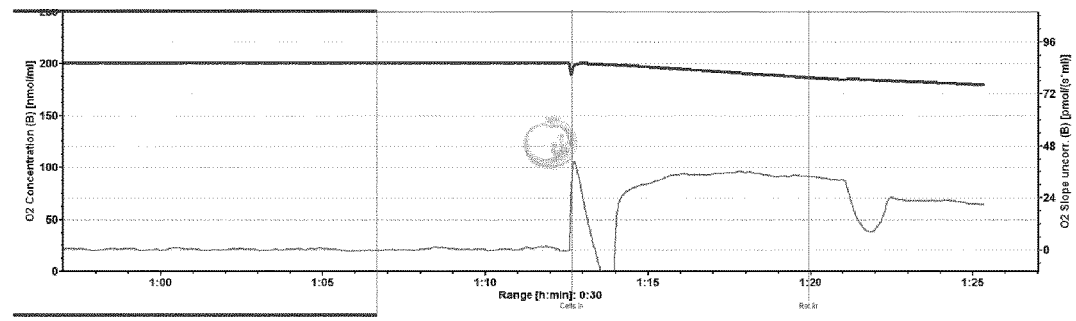

FIG. 12A. Oxygraphs for NSG constructs Trace showing oxygen concentration (blue line) and oxygen consumption (red line) in media containing untransfected cells (negative control A), cells transfected with wild-type Ndi1 (B) and cells transfected with NSG, a construct expressing both wild-type NDI1 and GDNF (C). In each case, cells were analysed without rotenone and a steady respiration level measured. Once respiration stabilized and a measurement taken, 5 μmol rotenone was added and a measurement of rotenone-insensitive respiration taken once oxygen consumption stabilized.

Figure 12B:
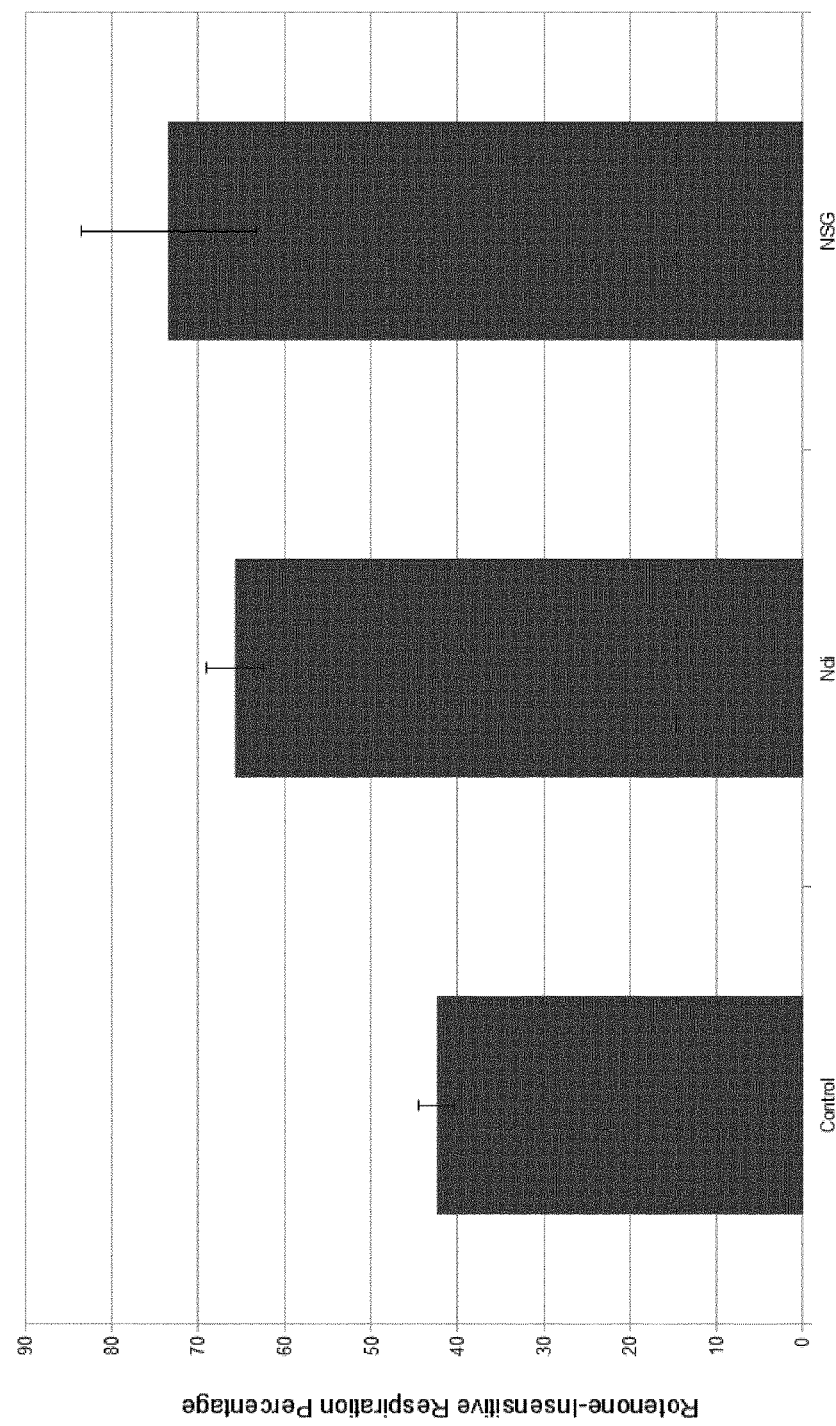

FIG. 12B: A bar chart of the data from NSG and NDI1 transfected HeLa cells is presented. NSG and NDI1 transfected HeLa cells did not differ significantly from each other p=0.6, however, both significantly retained oxygen consumption compared to untransfected controls (NSG $p<0.05$ and NDI1 $p<0.01$).

DETAILED DESCRIPTION OF THE INVENTION

In the present invention delivery of NDI1 constructs (FIG. 1) has been used to protect cells in the presence of a complex I inhibitor, rotenone, (FIGS. 2-8 and 12), HeLa cells and retinal ganglion cells (RGCs) were protected in the presence of NDI1 delivered as a wild type construct or as codon-optimised and immuno-optimised constructs (FIGS. 2-4). For example, RGCs, the cells primarily affected in LHON, were protected in a rotenone-induced murine model of LHON. Recombinant AAV serotype 2 (AAV2/2) expressing wild type NDI1 from a CMV promoter (AAV-NDI1, FIG. 1A) was administered to mice using a single intravitreal injection. AAV2/2 administered through this route has been shown to infect RGCs efficiently. Moreover, intravitreal injection typically results in a broad area of retinal transduction as the vitreous contacts the entire underlying retinal surface[32]. Intravitreal injection of AAV provides a route of administration for the gene therapy which is directly applicable to human patients and is routinely used to administer drugs such as Avastin and Lucentis for treatment of wet AMD. In this study, intravitreal injection of AAV-NDI1 was utilised for the first time and was shown significantly to reduce RGC death and optic nerve atrophy seen in untreated eyes in response to rotenone administration and moreover, led to a preservation of retinal function as assessed by manganese enhanced magnetic resonance imaging (MEMRI) and optokinetic responses (OKR; FIGS. 5-8).

In the present Application, intravitreal injection of AAV-NDI1 provided substantial protection against rotenone-induced insult, as assessed by a variety of assays (FIGS. 5-8). Notably, histological analyses demonstrated significant protection of both RGCs and the optic nerve (FIGS. 5 and 6). Furthermore, MEMRI indicated that AAV-NDI1 treatment preserved optic nerve function by enabling active transport of manganese ions through the optic nerve using voltage-gated calcium channels and hence provided evidence of the improved functional integrity of the optic nerve tissue in AAV-NDI1 treated eyes compared to control eyes (FIG. 7). Evaluation of visual function by optokinetics showed that the protection of RGCs and optic nerve integrity afforded by AAV-NDI1 led to preservation of mouse vision in the presence of the complex I inhibitor rotenone (FIG. 8). The results highlight the potential therapeutic value of NDI1-based therapies for LHON when intravitreally delivered using AAV2/2.

Following the successful delivery of AAV-NDI1 to RGCs using intravitreal injection, NDI1 was codon optimised so that codons which are used more frequently in mammalian cells were introduced to the NDI1 yeast gene. Codon modifications from 1-329 codons can be implemented to optimize expression of NDI1 in mammals while maintaining wild type amino acids. The maximal number of codons that can be altered in NDI1 to align codons with those most frequently used in mammals is 329 codons and these alterations were employed to generate a construct termed OphNDI1 and also known as humanized NDI1 (hNDI1). Plasmids containing OphNDI1 (hNDI1) or wild type NDI1, both expressed from a cytomegalovirus (CMV) promoter and containing a minimal polyadenylation (PolyA) signal, a modified rabbit beta-globin polyadenylation signal, were transiently transfected into HeLa cells using lipofectamine. Levels of NDI1 protein expression from NDI1 and hNDI1 constructs were compared using Western Blot analysis. hNDI1 (OphNDI1) was determined to express more highly than wild type NDI1 indicating that codon optimising the NDI1 gene has indeed enhanced expression in mammalian cells (FIGS. 9a, 9b and 10). A statistically significant difference in levels of expression was obtained between wild type and optimized NDI1 constructs (FIGS. 9a and 9b). The results obtained for NDI1 protein (FIGS. 9a and 9b) are mirrored by those obtained at the RNA level in mice intravitreally injected with AAV wild type and optimized NDI1 constructs using real-time RT PCR as the assay (FIG. 10).

In addition both the wild type and the codon-optimised NDI1 constructs have been immuno-optimised by introducing one or more amino acid changes to modulate the immune response(s) (Table 1a & 1b and Sequence Listing). Amino acid modifications were undertaken subsequent to in silico analyses for potential immunogenic sites within NDI1 (see FIGS. 11a and 11b, material and methods). Immuno-optimised constructs were generated for both the wild type NDI1 construct and for the codon-optimised hNDI1 construct. Modified codon-optimised and immuno-optimised NDI1 constructs were generated as high titre AAV2/2 vectors ($1-5\times10^{11}$ vg/ml) using triple plasmid transfection methods in 293 cells followed by cesium chloride gradient purification of virus. Representative immuno-optimised NDI1 and immuno-optimised hNDI1 constructs inter alia V45I, I82V, L89I, I90Y, V266I, L481I, L483M were generated as plasmids and or AAV vectors. All nucleated mammalian cells present peptide fragments bound to MHC-I molecules on their cell surface. These fragments are derived from the degradation of proteins in the cytoplasm. As such, MHC-I presentation offers a snapshot of the pool of proteins being produced within each cell. Cytotoxic T-cells inspect the peptide fragments presented by cells and can induce apoptosis in cells presenting non-self proteins, which is usually an indicator of viral infection. HeLa cells were transfected with NDI1, hNDI1 and immuno-optimised constructs and levels of rotenone insensitive respiration evaluated (FIGS. 2-4, 12). Significant retention of oxygen consumption was observed in cells transfected with NDI1, codon-optimised and immuno-optimised constructs (FIGS. 2-4, 12), when compared to untransfected control cells.

Figure 10A:
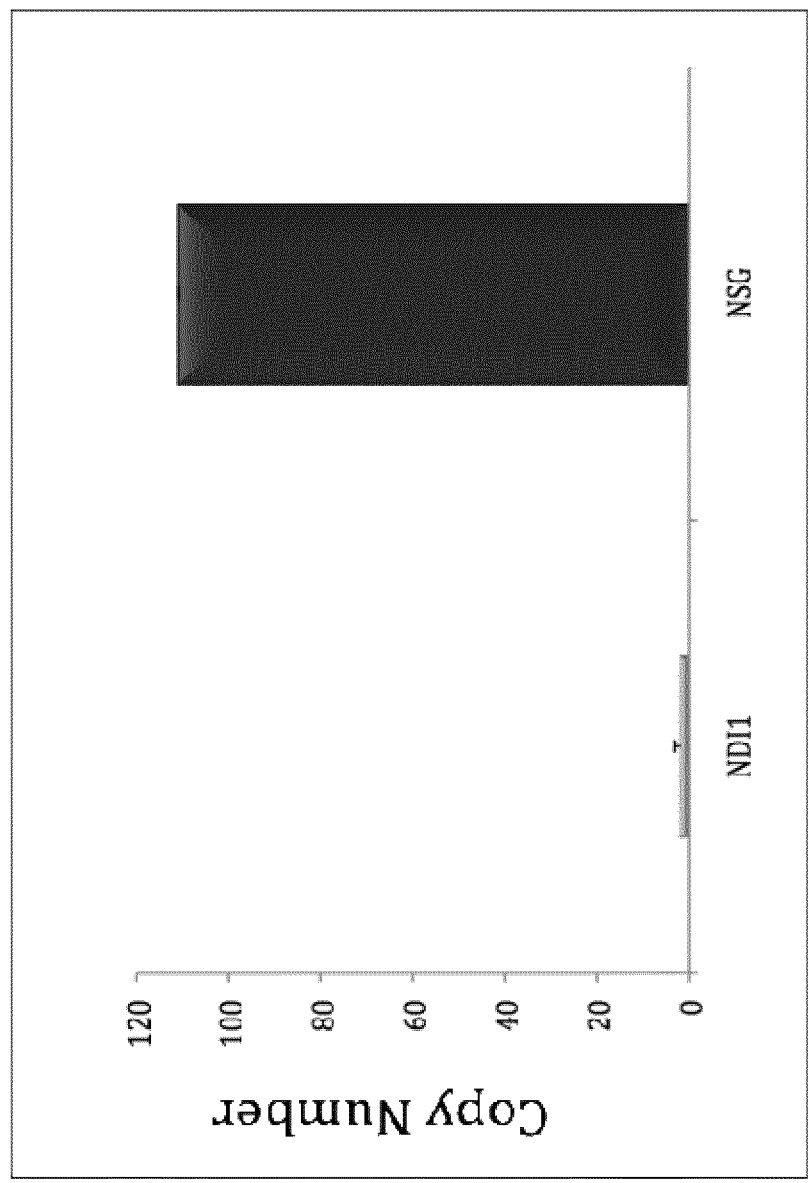
Figure 10B:
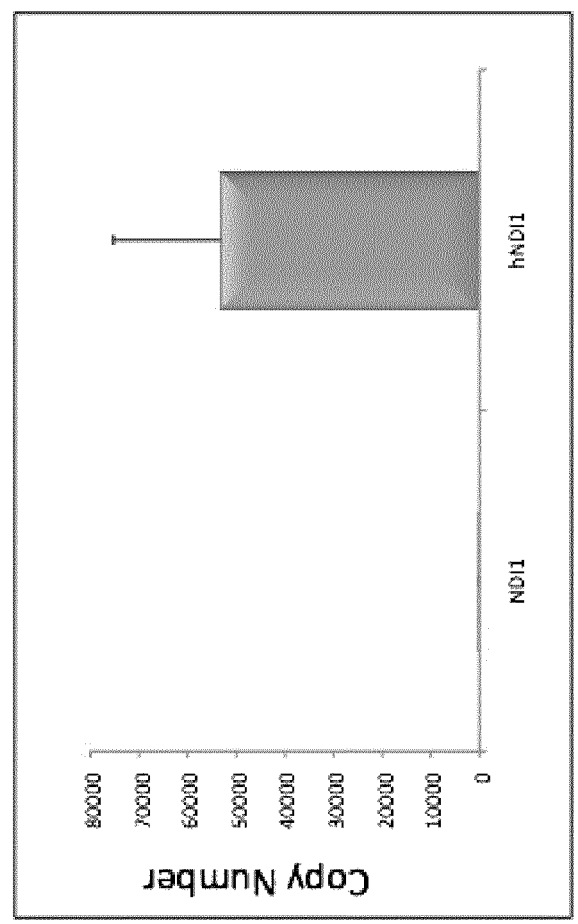
Figure 10C:
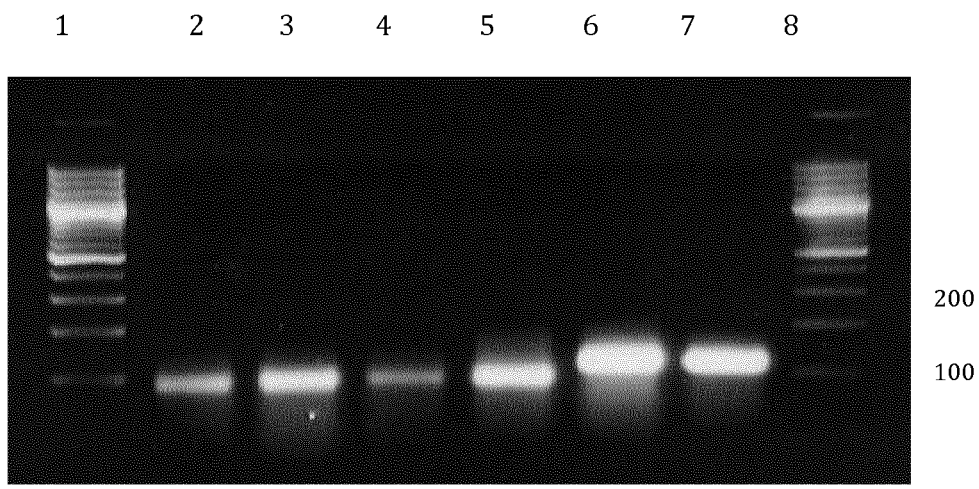

In addition, to codon-optimized and immuno-optimized NDI1 constructs, a dual component construct was generated containing the CMV promoter driven NDI1 gene together with a ubiquitin promoter driven glial derived neurotrophic factor (GDNF) gene (NSG), the latter employing a neurturin polyA signal (FIG. 1) and generated as an AAV2/2 vector (AAV-NSG). Significantly higher levels of expression of NDI1 were achieved from this vector in vivo in mice after intravitreal injection compared to AAV-NDI1 as evaluated by real time RT-PCR assays (FIGS. 10a and 10c). GDNF expression from AAV-NSG was confirmed in mouse retinas by real time RT-PCR. Furthermore, intravitreally delivery of AAV-NSG resulted in preservation of cell function as evaluated by oxygen consumption measurements in rotenone treated HeLa cells (FIG. 12) and functional preservation in vivo using MRI analyses of wild type mice intravitreally injected with AAV-NSG vector (FIG. 7). Mean MRI signal intensity for DMSO was 2.38±0.04, for rotenone alone was 2.30±0.06, for AAV-NDI1 plus rotenone was 2.35±0.07 and for AAV-NSG plus rotenone was 2.37±0.07, significant differences were found between the rotenone alone treated mice and those treated with rotenone and either AAV-NDI1 or AAV-NSG; for both rotenone versus AAV-NDI1 and rotenone versus AAV-NSG comparisons, $p<0.01$ (**). Indeed AAV-NDI1 (plus rotenone) or AAV-NSG (plus rotenone) treated mice did not differ significantly from wild type control mice treated with DMSO alone. Notably these MRI results were established using a 4-fold lower titre of AAV-NSG than AAV-NDI1 ($5.99\times10^{11}$ vp/ml versus $2.5\times10^{11}$ vp/ml) Suggesting that less AAV-NSG is required to mediate an equivalent beneficial effect.

Cohorts of adult wild type mice were intravitreally injected with 3 ul of AAV2/2 vectors expressing either NDI1, hNDI1, immuno-optimised hNDI1 I82V, immuno-optimised NDI1 V266I or AAV-NSG. Two weeks post-injection retinas were harvested from treated mouse eyes and total RNA extracted. Levels of expression from AAV vectors in mouse retinas were evaluated by real time RT-PCR (FIG. 10). Levels of expression from different vectors could be directly compared as expression was evaluated by absolute copy number per unit of β-actin (the housekeeping control) for each vector. The standard curves were generated using plasmid DNA standards with known copy number. Expression levels achieved after AAV intravitreal injection of vectors were greater in mouse eyes treated with AAV-hNDI1 or AAV-NSG treated eyes compared to AAV-NDI1 injected eyes (FIG. 10).

All gene therapies which deliver non-human proteins risk activation of cytotoxic T-cell responses following presentation of peptide fragments derived from the transgenic protein. It is therefore important to the success of the treatment that immunogenicity of the transgenic protein is modulated. One of the most effective ways this can be done is by searching the sequence of the protein for fragments which are likely to strongly bind MHC-I, increasing the likelihood that they will be presented on the cell surface and so induce an immune reaction.

This approach is complicated somewhat by the presence of many different MHC-I alleles in the human population, each of which may have slightly different binding affinities for different peptides.

There are established bioinformatics methods for predicting the MHC-I binding affinity of a particular peptide, several of which are available as downloadable tools. For our purposes, the consensus prediction method of Nielsen et al (Protein Sci. 2003 May; 12(5):1007-17) was most suitable, in addition to having excellent experimentally-validated accuracy. These tools were adapted and supporting software generated to enable prediction of affinity for a wide variety of MHC-I alleles. The computational tool thus generated may be applied and modified to predict other types of immune responses.

All potential peptide fragments that could be derived from the Ndi1 protein were assayed by the consensus prediction method for binding affinity to all well-characterised human MHC-I proteins.

Methods

Vector Construction and AAV Production

Figure 1:
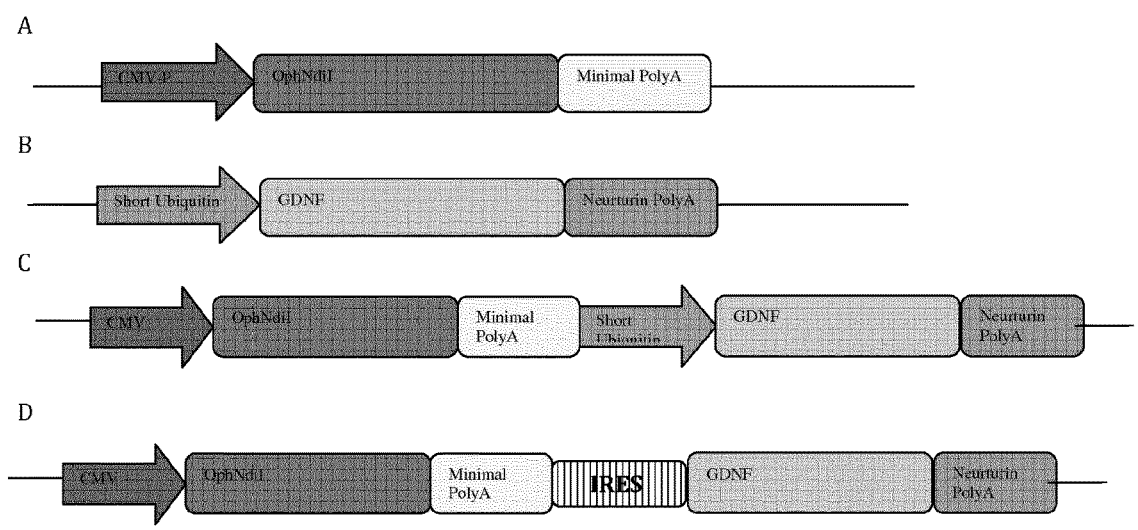
FIG. 1. Diagrammatic representation of the core construct designs. A: OphNDI1; OphNDI1 (yeast NDI1 gene which has been codon optimized and/or immune optimized) was expressed from the CMV (cytomegalovirus) immediate early promoter. A minimal polyadenylation signal was located at the 3' end of the NDI1 gene. B: AAV-GDNF; GDNF (glial cell line derived neurotrophic factor) was expressed from the short ubiquitin promoter. The neurturin polyadenylation signal was located at the 3' end of the GDNF gene. C: AAV-OphNDI1_GDNF; OphNDI1 was expressed from the CMV immediate early promoter. A minimal polyadenylation signal was located at the 3' end of the NDI1 gene. 3' to this GDNF was expressed from the short ubiquitin promoter. The neurturin polyadenylation signal was located at the 3' end of the GDNF gene. D: OphNdi1 expressed from a CMV promoter with a 3' minimal polyadenylation signal. In this construct GDNF is expressed from an IRES and also contains the neurturin Polyadenylation signal.

Yeast NDI1 (Accession No: NM_001182483.1) was cloned as described[53]. Briefly, NDI1 was PCR amplified from total yeast DNA extracted from S288c using the following primers F: TTCTCGAGGTAGGGTGTCA-GTTTC (SEQ ID NO: 543) and R: AAAGCGGCCGCA-GTGATCAACCAATCTTG (SEQ ID NO: 544) and cloned into XhoI and NotI sites of pcDNA3.1- (Invitrogen, Paisley, UK). A minimal poly-adenylation signals[4] was cloned downstream of NDI1 using NotI and EcoRV. The CMV immediate early promoter (present in pcDNA3.1-), the NDI1 gene and poly-adenylation signal were isolated on a MluI and EcoRV fragment, end filled and cloned into the NotI sites of pAAV-MCS (Agilent Technologies, La Jolla, Calif., USA) to create pAAV-NDI; FIG. 1. pAAV-EGFP was cloned as previously described[19].

The entire human GDNF coding sequence from the atg start codon (nucleotides 201-836 of accession number NM_000514) was cloned 3-prime of a 347 bp human Ubiquitin promoter (nucleotides 3557-3904 of accession number D63791) and a human Neurturin polyA consisting of nucleotides 1057-1160 of accession number AL161995 was cloned down-stream of the GDNF gene. This entire ubiquitin-driven GDNF cassette, including Neurturin polyA was cloned downstream of the CMV-driven NDI1 (including the rabbit b-globulin polyA).

Codon optimized NDI1 sequences and/or with amino acid changes to reduce immunogenicity profiles were synthesized by Geneart Inc. These were isolated on a XbaI and XhoI fragment and cloned into pAAV-MCS (Agilent Technologies, La Jolla, Calif., USA) and pcDNA3.1- (Invitrogen, Paisley, UK) plasmids with a CMV immediate early promoter and minimal polyA and verified by DNA sequencing.

Recombinant AAV2/2 viruses, AAV-ND1, AAV-NSG, pAAV-NDI1 V266I, AAV-huNDI1, pAAV-huNDI1 I82V and AAV-EGFP were prepared as described[20], with a modified cesium chloride gradient as described[19] Additional AAV-ND1, AAV-NSG recombinant AAV2/2 viruses were generated by the Gene Vector production Center of Nantes. Genomic titres (DNase-resistant viral particles per milliliter; vp/ml) were determined by quantitative real-time-polymerase chain reaction (qRT-PCR) according to the method of Rohr et al.[21]

Cell Culture

Human cervical carcinoma cells (HeLa, ATCC accession no. CCL-2) were transfected with pAAV-NDI1 or pAAV-EGFP using Lipofectamine 2000 reagent, according to the manufacturer's instructions (Invitrogen, Carlsbad, Calif., USA). $5 \times 10^5$ cells per well were seeded onto 6-well plates containing 1 ml Dulbecco's modified Eagle medium supplemented with 10% calf serum, 2 mM glutamine and 1 mM sodium pyruvate and incubated overnight at 37° C. Media was then aspirated and the cells were washed twice with phosphate-buffered saline (PBS). Each well was transfected with 1 μg pAAV-NDI1 or 1 μg pAAV-EGFP in triplicate. Cells were harvested 48 hrs later and the cells from each triplicate pooled for an individual experiment, each experiment was repeated in triplicate.

Mitochondrial Isolation and Western Blot Analysis

Mitochondria were isolated from HeLa cells using Anti-TOM22 microbeads (Mitochondria isolation kit, Miltenyi Biotec GmbH, Germany). Isolated mitochondria were washed twice in PBS and homogenised in 100 μl radioimmunoprecipitation assay (RIPA) buffer (150 mM NaCl, 1% Triton X-100, 0.5% sodium deoxycholate, 0.1% SDS, 50 mM TrisCl pH 8.0 and 1 protease inhibitor cocktail tablet/10 mls (Roche, Mannheim, Germany)). The homogenate was centrifuged at 10,000 g for 20 min at 4° C. and the supernatant removed for analysis. Normalised protein samples were separated on 12% polyacrylamide gels and electrophoretically transferred to PVDF membranes (Bio-Rad, Berkley, Calif., USA). The PVDF membrane was blocked with 5% non-fat milk in tris buffered saline (TBS, 0.05M Tris, 150 mM NaCl, pH 7.5) and 0.05% (vol/vol) Tween 20 for 1 hr at room temperature. Rabbit polyclonal antibodies to NDI1 (1:500, Cambridge Research Biochemicals, Cleveland, UK) and VDAC1 (1:1000, Abcam, Cambridge, UK) were diluted in 5% milk and incubated overnight at 4° C. Membranes were washed twice with TBS and incubated with a secondary anti-rabbit (IgG) horseradish peroxidise-conjugated antibody (1:2500, Sigma-Aldrich, St. Louis Mo., USA) for 2 hr at room temperature, exposed to Super-Signal chemiluminescent substrate and enhancer (Pierce Biotechnology, Rochford, Ill., USA) and signal detected using X-ray film (Kodak, Rochester, N.Y., USA). All Western blots were repeated three times.

Respiratory Analysis

Respiratory measurements were performed in DMEM at 37° C. on an Oxygraph-2k (OROBOROS® INSTRUMENTS GmbH, Innsbruck, Austria) according to the manufacturer's instructions. Briefly, each chamber was calibrated with 2 mls DMEM and stirred (200 rpm) for 1 hr to saturate the media with oxygen. Parallel experiments were run in the two chambers of the Oxygraph-2k using $1 \times 10^6$ pAAV-NDI1 or $1 \times 10^6$ pAAV-EGFP transfected HeLa cells. Following the addition of cells to the oxygen saturated media the chamber size was reduced to 2 ml to remove air. Continuous readings were taken to establish the fully oxygenated baseline. 2 ul 5 mM rotenone (5 μM in 100% ethanol) was added to $1 \times 10^6$ pAAV-NDI1 or $1 \times 10^6$ pAAV-EGFP transfected HeLa cells prior to transfer to the requisite chambers and continuous post-rotenone readings taken. Continuous readings were taken both with and without rotenone until oxygen consumption stabilised. Readings were taken from three independent transfections for each construct.

Animals and Intravitreal Injections

Wild type 129 S2/SvHsd (Harlan UK Ltd, Oxfordshire, UK) mice were maintained under specific pathogen free (spf) housing conditions. Intravitreal injections were carried out in strict compliance with the European Communities Regulations 2002 and 2005 (Cruelty to Animals Act) and the Association for Research in Vision and Ophthalmology (ARVO) statement for the use of animals. Briefly, adult mice were anaesthetised and pupils dilated as described[57]. Using topical anaesthesia (Amethocaine), a small puncture was made in the sclera. A 34-gauge blunt-ended microneedle attached to a 10 μl Hamilton syringe was inserted through the puncture, and 0.6 μl 2.5 mM rotenone (1.5 nmol) in dimethyl sulfoxide (DMSO, vehicle), 0.6 μl DMSO alone or 3 μl $1 \times 10^{12}$ vp/ml AAV2/2 was slowly, over a two minute period, administered into the vitreous. Following intravitreal injection, an anesthetic reversing agent (100 mg/10 g body weight; Atipamezole Hydrochloride) was delivered by intraperitoneal injection. Body temperature was maintained using a homeothermic heating device. All animal studies have been approved by the authors' Institutional Review Board.

RNA Extraction and PCR Analysis

Adult wild type mice (n=6) were intravitrally injected with $3 \times 10^9$ vp AAV-NID1 while fellow eyes received $3 \times 10^9$ vp AAV-EGFP. Retinas were harvested two weeks post-injection and total RNA extracted using the QIAGEN RNEASY™ Qiagen RNeasy kit according to the manufacturer's specification. In vivo expression of NDI1 from AAV-NDI1 was confirmed by reverse transcription PCR (RT-PCR) on a 7300 Real Time PCR System (APPLIED BIOSYSTEMS™, Foster City, Calif., USA) and resulting amplification products separated and sized on 2.5% agarose gels. The following primers were used: NDI1 forward primer 5' CACCAGTTGGGACAGTAGAC 3' (SEQ ID NO: 545) and NDI1 reverse primer: 5' CCTCATAGTAGG-TAACGTTC 3' (SEQ ID NO: 546). Humanised forms of NDI1 transcript were RT-PCR amplified with hNDI1 forward primer 5' GAACACCGTGACCATCAAGA 3' (SEQ ID NO: 1008) and hNDI1 reverse primer 5' GCTGATCA-GGTAGTCGTACT 3'(SEQ ID NO: 1009). β-actin was used as an internal control as described (ref). RT-PCRs were performed twice in triplicate or quadruplicate. Levels of NDI1 or humanized NDI1 expression were determined by real time RT PCR using the QUANTITECT™ SYBR green RT PCR kit (QIAGEN™). Briefly, the copy number of two plasmid DNA preparations containing either NDI1 or humanized NDI1 was determined by spectraphotometry on a NanoDrop and serial dilutions of these plasmid DNA preparations were prepared containing between 10e2-10e7 copies/μl. These standard curves were included in 96-well plates that also included RNA samples to be analysed. Hence expression levels from all constructs, whether humanized or not, could be compared using absolute copy number, even though the primer pairs used for non: humanized and humanized PCR amplification were not the same. Expression levels were normalized using the internal housekeeping gene β-actin.

Histology

Eyes and optic nerves were fixed in 4% paraformaldehyde in PBS (pH 7.4) overnight at room 4° C. washed three times with PBS and cryoprotected using a sucrose gradient (10%, 20%, 30%). 10 μm sections were cut on a cryostat (HM 500 Microm, Leica, Solms, Germany) at −20° C. Nuclei were counterstained with 4',6-diamidino-2-phenylindole (DAPI). Specimens were analysed with a Zeiss Axiophot fluorescence microscope (Carl Zeiss, Oberkochen, Germany). Corresponding microscope images taken with different filters were overlaid using Photoshop v. 10 (Adobe Systems Europe, Glasgow, UK). For ganglion cell (GCL) counts the ganglion cells were labelled using NeuN (Abcam, Cambridge, UK) immunohistochemistry as previously described.

The primary antibody was diluted 1:100 and visualised using cy3-conjugated anti-mouse-IgG secondary antibody (Jackson ImmunoResearch Europe, Suffolk, UK). Four retinal sections per eye from four mice per group were analysed (n=4). The sections were taken approximately 150 µm apart in the central retina (600 µm span in total); 2 counts per section i.e. 8 counts per eye in total, were made using the count tool in Photoshop (Adobe systems). The diameter of the optic nerves was determined at approximately 5 mm from the optic nerve head from 3 animals per group (n=3). Three measurements per nerve were made approximately 150 µm apart using the ruler tool in Photoshop (Adobe Systems). Procedures for TEM were as previously described. Briefly, three weeks post-rotenone injection optic nerves were fixed in 4% paraformaldehyde in phosphate-buffered solution and fixed in 2.5% glutaraldehyde in 0.1M cacodylate buffer (pH 7.3) for 2 hr at room temperature. Washed specimens were post-fixed in buffered 2% osmium tetroxide, dehydrated and embedded in araldite. Ultrathin cross-sections were cut on a vibratome (Leica VT 1000 S), analysed using a Tecnai 12 BioTwin transmission electron microscope (FEI, Eindhoven, Holland) and imaged with a SIS MegaView III surface channel charge-coupled device (SCCD) camera (Olympus Soft Imaging Solutions, Münster, Germany). The total number of membrane debris particles in the images was counted in 5 cross sections per optic nerve from 3 animals per group (n=3).

Magnetic Resonance Imaging

Optic nerve integrity in experimental and control mice was assessed by Manganese (Mn2+) enhanced magnetic resonance imaging (MEMRI) technique using a 7 T Bruker Biospec 70/30 magnet (Bruker Biospin, Etlingen, Germany). MEMRI demarcates active regions of the brain due to the ability of Mn2+ ions to enter excitable cells through voltage-gated calcium channels, thus analysis of Mn2+ transport through the optic nerve provides a good measure of its integrity. Two hours prior to scanning, mice were anaesthetised and intravitreally injected, as described above, with 2 µl of 20 mg/ml manganese chloride solution. For image acquisition, mice were maintained under sedation with ketamine (375 µg/10 g body weight) and placed on an MRI-compatible cradle which maintains the animal's body temperature at 37° C. (respiration and temperature were monitored for the duration of experiment). The cradle was positioned within the MRI scanner and an initial rapid pilot image acquired to ensure accurate positioning of the mouse. Oblique coronal T1-weighted 2D images were acquired using FLASH sequence (TR/TE:150/2.5 ms; Matrix: 128× 128; Field of View: 20×20 mm2; Flip Angle 50°; number of averages: 40, the pixel resolution was 0.156 mm/pixel). In the oblique coronal orientation (36°), 20 slices, each measuring 0.35 mm in thickness with 0.45 mm inter slice gap, were recorded for an acquisition time of 9 min 36 sec. MRI scans corresponding to the area immediately superior to the optic chiasm provided more consistent images compared to the optic nerve itself due to the variations in physically positioning each animal. Log signal intensities in this region were quantified using Image J© software (available on the world wide web at imagej.nih.gov/ij.

Optokinetics

Optokinetic response (OKR) spatial frequency thresholds were measured blind by two independent researchers using a virtual optokinetic system (VOS, OptoMotry, Cerebral-Mechanics, Lethbridge, AB, Canada). OptoMotry[36] measures the threshold of the mouse's optokinetic tracking response to moving gratings. Briefly, a virtual-reality chamber is created with four 17 inch computer monitors facing into a square and the unrestrained mouse was placed on a platform in the centre. A video camera, situated above the animal, provided real-time video feedback. The experimenter centred the virtual drum on the mouse's head and judged whether the mouse made slow tracking movements with its head and neck. The spatial frequency threshold, the point at which the mouse no longer tracked, was obtained by incrementally increasing the spatial frequency of the grating at 100% contrast. A staircase procedure was used in which the step size was halved after each reversal, and terminated when the step size became smaller than the hardware resolution (~0.003 c/d, 0.2% contrast). One staircase was presented for each direction of rotation to measure each eye separately, with the two staircases being interspersed.

Statistical Analysis

Data sets of treated and untreated samples were pooled, averaged and standard deviation (SD) values calculated. Statistical significance of differences between data sets was determined by either Student's two-tailed t-test or ANOVA used with Tukey's multiple comparison post hoc test. In addition, the Kruskall-Wallis one-way analysis of variance was applied to the MRI data set and Mann Whitney U-tests were undertaken on all other data sets to establish that statistical significance was maintained using nonparametric statistical models. Analysis was performed using Prism v. 5.0 c (GraphPad Software, La Jolla, Calif., USA); differences with $p<0.05$ were considered statistically significant Predictions of Immunogenic Codons All potential peptide fragments that could be derived from the Ndi1 protein were assayed by the consensus prediction method for binding affinity to all well-characterised human MHC-I proteins. All epitopes displaying a high affinity for MHC-I (defined as a predicted IC50<500 nM) were noted, along with the corresponding MHC-I allele to which they had displayed high binding affinity. Each potential peptide fragment was then assigned an 'immunogenicity score', defined as the sum of the frequencies of all MHC-I alleles in the global human population for which it had a high binding affinity. The highest-scoring fragments were then selected for potential modification to reduce immunogenicity. All possible single amino acid mutations for each of these immunogenic fragment sequences were generated, and each was assayed for immunogenicity by the above methods. In addition, the BLOSUM62 matrix was used to calculate the sequence similarity between the original and mutated sequences. For each fragment, an optimal immunogenicity-reducing mutation was chosen. This was done by taking the set of all potential mutations for that fragment and eliminating all fragments which had an immunogenicity score greater than half of the immunogenicity score of the original fragment. The sequence with the highest sequence similarity to the original fragment (as defined by the BLOSUM62 matrix) was selected as the optimal substitution for that position.

In addition to the analyses described above using information regarding MHC-1 alone, immunogenicity estimation and reduction in Ndi1 was achieved via in silico modelling of antigen presentation via the MHC-I pathway using the IEDB proteasomal cleavage/TAP transport/MHC class I combined predictor.

As fragments of 9 amino acids in length are the most commonly presented fragments by MHC-I, all possible sequences of 9 consecutive amino acids that could be derived from Ndi1 were listed and passed to the IEDB predictor for analysis. For every 9-mer peptide P and MHC-I allele i, an immunogenicity value $G_{p,i}$ was generated which is proportional to the amount of that fragment that would be displayed on the cell surface by a given MHC-I allele, taking into account proteasomal degradation, transport and binding by MHC-I.

An overall immunogenicity factor $F_p$ for the 9-mer peptide was then calculated as $$F_p = \sum^i G_{p,i} N_i$$

where $N_i$ is the estimated prevalence of each allele in the global human population as a fraction of the total pool of alleles, calculated using population frequency data from The Allele Frequency Net Database (Gonzalez-Galarza et al, 2011). In other words, $F_p$ represents the mean amount of that fragment that would be displayed on the surface of a cell for all MHC-I alleles, weighted by how frequently each allele occurs in the human population.

Each amino acid position A in the Ndi1 peptide was then assigned an immunogenicity score $S_A$ defined as the sum of the immunogenicity factors for all 9-mer peptides containing that amino acid. All positions whose immunogenicity score was less than one-fifth of the highest score were not considered further, as mutations at these positions would not be able to significantly affect the overall immunogenicity of the protein.

For each of the remaining positions, a BLOSUM matrix (Henikoff and Henikoff, 1992) was used to identify potential mutations that would not be overly disruptive to the structure or function of Ndi1. A BLOSUM matrix is calculated by aligning homologous protein sequences from many species against each other, and comparing the frequency with which each amino acid is replaced by every other amino acid.

For two amino acids x and y, the BLOSUM score $B_{x,y}$ is defined as the log-likelihood of the amino acid x replacing y or vice-versa in a given position in homologous peptides. As a direct consequence of this definition, $B_{x,y}=B_{y,x}$ for all x and y (in other words, all BLOSUM matrices are symmetric).

A high BLOSUM score for an amino-acid pair indicates that mutations changing one of those amino acids to the other are more likely to be observed in homologous proteins, indicating that such changes are less likely to severely disrupt protein structure. A BLOSUM score can also be calculated between each amino acid and itself ($B_{x,x}$), indicating the likelihood that that amino acid will remain constant between homologous proteins.

For all possible mutations at a given position, $\Delta B$ was defined as the change in the BLOSUM score for that mutation. More formally, given an initial amino acid x and a candidate replacement amino acid y, $\Delta B = B_{x,x} - B_{x,y}$. All mutations for which $\Delta B$ was greater than 4 were considered too disruptive to protein function and not analysed further.

For all remaining candidate mutations, immunogenicity factors F and scores S were recalculated for the post-mutation peptide using the IEDB predictor. The reduction in immunogenicity $\Delta S$ was then determined, defined as the difference between the score S for that position in the original peptide versus the new score S after mutation.

All possible mutations were then ranked by the metric $$\frac{\Delta S}{\Delta B}.$$

High values of $$\frac{\Delta S}{\Delta B}$$

represent mutations which are likely to cause a large reduction in immunogenicity with a relatively small predicted impact on protein function. Outputs with predicted amino acids and scores are provided in Table X.

The invention is not limited to the embodiments hereinbefore described which may be varied in construction and detail without departing from the spirit of the invention.

REFERENCES

1. Yu-Wai-Man P, Griffiths P G, Chinnery P F. Mitochondrial optic neuropathies—disease mechanisms and therapeutic strategies. *Prog Retin Eye Res.* 30:81-114 (2011).
2. Chalmers R M and Schapira A H. Clinical, biochemical and molecular genetic features of Leber's hereditary optic neuropathy. *Biochim Biophys Acta.* 1410 (2):147-158 (1999).
3. Mackey D A, Oostra R J, Rosenberg T, Nikoskelainen E, Bronte-Stewart J, Poulton J, Harding A E, Govan G, Bolhuis P A, Norby S. Primary pathogenic mtDNA mutations in multigeneration pedigrees with Leber hereditary optic neuropathy. *Am J Hum Genet.* 59 (2):481-485 (1996).
4. Jarrett S G, Lin H, Godley B F, Boulton M E. Mitochondrial DNA damage and its potential role in retinal degeneration. *Prog Retin Eye Res.* 27 (6):596-607 (2008).
5. Ames A $3^{rd}$. CNS energy metabolism as related to function. *Brain Res Brain Res Rev.* 34:42-68 (2000).
6. Yen M Y, Wang A G, Wei Y H. Leber's hereditary optic neuropathy: a multifactorial disease. *Prog Retin Eye Res.* 25 (4):381-396 (2006).
7. Porter R K, Joyce O J, Farmer M K, Heneghan R, Tipton K F, Andrews J F, McBennett S M, Lund M D, Jensen C H, Melia H P. Indirect measurement of mitochondrial proton leak and its application. *Int J Obes Relat Metab Disord.* 23 (Suppl 6):512-18 (1999).
8. Yamada K, Mashima Y, Kigasawa K, Miyashita K, Wakakura M, Oguchi Y. High incidence of visual recovery among four Japanese patients with Leber's hereditary optic neuropathy with the 14484 mutation. *J. Neuroophthalmol.* 17 (2):103-107 (1997).
9. Marcuello A, Martinez-Redondo D, Dahmani Y, Casajús J A, Ruiz-Pesini E, Montoya J, López-Pérez M J, Díez-Sánchez C. Human mitochondrial varienats influence on oxygen consumption. *Mitochondrion.* 9:27-30 (2009).
10. Hudson G, Carelli V, Spruijt L, Gerards M, Mowbray C, Achilli A, Pyle A, Elson J, Howell N, La Morgia C, Valentino M L, Huoponen K, Savontaus M L, Nikoskelainen E, Sadun A A, Salomao S R, Belfort R Jr, Griffiths P, Man P Y, de Coo R F, Horvath R, Zeviani M, Smeets H J, Torroni A, Chinnery P F. Clinical expression of Leber hereditary optic neuropathy is affected by the mitochondrial DNA-haplogroup background. *Am J Hum Genet.* 81:228-233 (2007).
11. Shankar S P, Fingert J H, Carelli V, Valentino M L, King T M, Daiger S P, Salomao S R, Berezovsky A, Belfort R Jr, Braun T A, Sheffield V C, Sadun A A, Stone E M. Evidence for a novel x-linked modifier locus for leber hereditary optic neuropathy. *Ophthalmic Genet.* 29 (1): 17-24 (2008).

12. Tsao K, Aitken P A, Johns D R. Smoking as an aetiological factor in a pedigree with Leber hereditary optic neuropathy. *Br J. Ophthalmol.* 83 (5):577-581 (1999).
13. Giordano C, Montopoli M, Perli E, Orlandi M, Fantin M, Ross-Cisneros F N, Caparrotta L, Martinuzzi A, Ragazzi E, Ghelli A, Sadun A A, d'Amati G, Carelli V. Oestrogens ameliorate mitochondrial dysfunction in Leber's hereditary optic neuropathy. *Brain.* 134 (Pt 1):220-234 (2011).
14. Qi X, Sun L, Lewin A S, Hauswirth W W, Guy J. The mutant human ND4 subunit of complex I induces optic neuropathy in the mouse. *Invest Ophthalmol Vis Sci.* 48 (1):1-10 (2007).
15. Ellouze S, Augustin S, Bouaita A, Bonnet C, Simonutti M, Forster V, Picaud S, Sahel J A, Corral-Debrinski M. Optimized allotopic expression of the human mitochondrial ND4 prevents blindness in a rat model of mitochondrial dysfunction. *Am J Hum Genet.* 83 (3):373-387 (2008).
16. Koilkonda R D, Guy J. Leber's Hereditary Optic Neuropathy-Gene Therapy: From Benchtop to Bedside. *J Ophthalmol.* 2011: 179412 [Epub ahead of print] (2011).
17. Marella M, Seo B B, Yagi T, Matsuno-Yagi A. Parkinson's disease and mitochondrial complex I: a perspective on the Ndi1 therapy. *J Bioenerg Biomembr.* 41 (6):493-497 (2009).
18. Marella M, Seo B B, Thomas B B, Matsuno-Yagi A, Yagi T. Successful amelioration of mitochondrial optic neuropathy using the yeast NDI1 gene in a rat animal model. *PLoS One.* 5 (7):e11472 (2010).
19. Palfi A, Millington-Ward S, Chadderton N, O'Reilly M, Goldmann T, Humphries M M, Li T, Wolfrum U, Humphries P, Kenna P F, Farrar G J. Adeno-associated virus-mediated rhodopsin replacement provides therapeutic benefit in mice with a targeted disruption of the rhodopsin gene. Hum Gene Ther. 2010 March; 21 (3): 311-23.
20. Ayuso E, Mingozzi F, Montane J, Leon X, Anguela X M, Haurigot V, Edmonson S A, Africa L, Zhou S, High K A, Bosch F, Wright J F High AAV vector purity results in serotype- and tissue-independent enhancement of transduction efficiency. *Gene Ther.* 2010 April; 17 (4):503-10.

21. Rohr U P, Wulf M A, Stahn S, Steidl U, Haas R, Kronenwett R. *Fast and reliable titration of recombinant adeno-associated virus type-*2 *using quantitative real-time PCR. J Virol Methods.* 2002 October; 106(1):81-8.

22. Kormann M S, Hasenpusch G, Aneja M K, Nica G, Flemmer A W, Herber-Jonat S, Huppmann M, Mays L E, Illenyi M, Schams A, Griese M, Bittmann I, Handgretinger R, Hartl D, Rosenecker J, Rudolph C. Expression of therapeutic proteins after delivery of chemically modified mRNA in mice. Nat. Biotechnol. 2011 February; 29 (2):154-7. doi: 10.1038/nbt.1733. Epub 2011 Jan. 9.
23. Chaput J C, Yu H, Zhang S. The emerging world of synthetic genetics. Chem. Biol. 2012 Nov. 21; 19 (11): 1360-71. doi: 10.1016/j.chembiol.2012.10.011.

APPENDIX

TABLE 1a

Nucleic acid and amino acid sequences of the Invention.

| Gene | Amino Acid Substitution | Nucleic Acid Sequence |
|---|---|---|
| Yeast NDI1 | FYLWRILYL | SEQ ID NO: 1 |
| Yeast NDI1 codon optimised | FYLWRILYL | SEQ ID NO: 62 |
| Yeast NDI1 + 1 amino acid change | FYLWRILYL → FYLWRILYM | SEQ ID NO: 63 |
| Yeast NDI1 codon optimized + 1 amino acid change | FYLWRILYL → FYLWRILYM | SEQ ID NO: 134 |
| Yeast NDI1 + 2 amino acid change | FYLWRILYL → FYLWRILYM FLKEIPNSL → FFKEIPNSL | SEQ ID NO: 146 |
| Yeast NDI1 codon optimized + 2 amino acid change | FYLWRILYL → FYLWRILYM FLKEIPNSL → FFKEIPNSL | SEQ ID NO: 225 |

TABLE 1b

| Initial | Position | New | Immunoscore | Immunochange | Blosumchange | Immunochange/ Blosumchange |
|---|---|---|---|---|---|---|
| I | 82 | V | 2.569262982 | 1.002693684 | 2 | 0.501346842 |
| F | 90 | Y | 1.926170105 | 1.497108683 | 3 | 0.499036228 |
| L | 89 | I | 2.104411858 | 1.253907982 | 3 | 0.417969327 |
| V | 266 | I | 0.667339713 | 0.362552877 | 1 | 0.362552877 |
| K | 214 | E | 0.712950213 | 0.70677809 | 4 | 0.176694523 |
| L | 481 | I | 0.885723713 | 0.498012741 | 3 | 0.166004247 |
| L | 202 | M | 0.608956047 | 0.315494717 | 2 | 0.157747359 |
| L | 259 | V | 0.594189679 | 0.469145841 | 3 | 0.156381947 |

TABLE 1b-continued

| Initial | Position | New | Immunoscore | Immunochange | Blosumchange | Immunochange/Blosumchange |
|---|---|---|---|---|---|---|
| L | 195 | I | 0.565666654 | 0.465061673 | 3 | 0.155020558 |
| I | 81 | V | 0.852520887 | 0.266903644 | 2 | 0.133451822 |
| L | 150 | M | 0.656551833 | 0.259100799 | 2 | 0.129550399 |
| R | 85 | K | 2.714843954 | 0.43039463 | 4 | 0.107598657 |
| Y | 151 | F | 0.686249712 | 0.397772899 | 4 | 0.099443225 |
| Y | 482 | F | 0.891857027 | 0.37332648 | 4 | 0.09333162 |
| S | 488 | T | 0.562058188 | 0.361418691 | 4 | 0.090354673 |
| S | 80 | T | 0.674070843 | 0.301172594 | 4 | 0.075293149 |
| K | 196 | E | 0.618739275 | 0.284207587 | 4 | 0.071051897 |
| R | 206 | K | 0.780227471 | 0.247789757 | 4 | 0.061947439 |
| R | 490 | K | 0.590906411 | 0.237769694 | 4 | 0.059442424 |
| S | 145 | T | 0.67224222 | 0.225480169 | 4 | 0.056370042 |
| V | 147 | T | 0.671708207 | 0.210263616 | 4 | 0.052565904 |
| R | 479 | K | 1.226655337 | 0.210156887 | 4 | 0.052539222 |
| A | 489 | S | 0.587738848 | 0.201645996 | 4 | 0.050411499 |
| L | 212 | V | 0.717379457 | 0.144498379 | 3 | 0.048166126 |
| R | 492 | K | 0.564269712 | 0.191259766 | 4 | 0.047814941 |
| L | 262 | M | 0.596470347 | 0.084255646 | 2 | 0.042127823 |
| Q | 149 | E | 0.656724126 | 0.167775872 | 4 | 0.041943968 |
| T | 207 | S | 0.779275641 | 0.162365948 | 4 | 0.040591487 |
| Y | 476 | F | 1.203763001 | 0.154940174 | 4 | 0.038735043 |
| S | 201 | T | 0.598628015 | 0.145693616 | 4 | 0.036423404 |
| S | 86 | A | 2.752011125 | 0.111576956 | 4 | 0.027894239 |
| M | 473 | L | 0.621739886 | 0.108503212 | 4 | 0.027125803 |
| E | 265 | Q | 0.583898093 | 0.099401686 | 4 | 0.024850422 |
| E | 264 | Q | 0.583540076 | 0.086415603 | 4 | 0.021603901 |
| S | 148 | A | 0.642943664 | 0.069504199 | 4 | 0.01737605 |
| A | 261 | S | 0.592734437 | 0.053926096 | 4 | 0.013481524 |
| A | 209 | S | 0.725497927 | 0.039698254 | 4 | 0.009924564 |
| E | 213 | Q | 0.71301777 | 0.004330404 | 4 | 0.001082601 |

Initial: The amino acid at this position in the native protein
Position: Position in the protein
New: Replacement amino acid suggested by the program
Immunoscore: Immunoscore for this locus in the native protein.
Immunochange: Change in immunoscore between the native and the modified locus.
Blosumchange: The change in BLOSUM score between the native and the modified position (a measure of how conservative the change is, lower numbers being more conservative)
Immunochange/Blosumchange: The change in immunogenicity divided by the blosum change.

TABLE 1c

| Output from immunogenicity analyses | | | | |
|---|---|---|---|---|
| position | totalscore | mhcscore | tapscore | proteasomescore |
| 0 | 0.000165143 | 11.14069809 | 0.44351918 | 9.06162E−05 |
| 1 | 0.041457346 | 11.40019829 | 2.86360034 | 0.003448543 |
| 2 | 0.002426595 | 15.73665433 | 7.707479979 | 5.46497E−05 |
| 3 | 0.002526801 | 24.94091632 | 4.435191796 | 6.27721E−05 |
| 4 | 0.005897232 | 16.1032081 | 6.122268966 | 0.000162811 |
| 5 | 0.00032745 | 12.79123286 | 1.221553255 | 5.69915E−05 |
| 6 | 7.91604E−05 | 15.37844434 | 0.168621289 | 8.22938E−05 |
| 7 | 0.000166722 | 13.39406509 | 0.702930528 | 4.84144E−05 |
| 8 | 0.000109826 | 14.68630033 | 0.533227336 | 3.79468E−05 |
| 9 | 0.000316701 | 11.14069809 | 1.308917895 | 5.83262E−05 |
| 10 | 0.123430476 | 22.74638603 | 6.264874929 | 0.002349837 |
| 11 | 0.097134418 | 17.65681657 | 2.552186489 | 0.005899826 |
| 12 | 0.048628469 | 20.27273789 | 7.532036315 | 0.000863136 |
| 13 | 0.046499396 | 20.74495061 | 21.22816259 | 0.000286354 |
| 14 | 0.001693195 | 20.74495061 | 0.926642906 | 0.000243003 |
| 15 | 2.94196E−05 | 11.40019829 | 0.150283882 | 4.66216E−05 |
| 16 | 0.000555893 | 11.14069809 | 0.845108374 | 0.000157342 |
| 17 | 0.062993668 | 16.4783 | 9.055499382 | 0.001146233 |
| 18 | 0.000129314 | 12.79123286 | 0.212281626 | 0.000129245 |
| 19 | 0.000372025 | 11.93747308 | 1.250006885 | 6.79306E−05 |
| 20 | 0.000170764 | 11.40019829 | 0.656012939 | 6.24617E−05 |
| 21 | 0.017125463 | 13.39406509 | 2.437319175 | 0.00142792 |
| 22 | 8.29984E−05 | 14.68630033 | 0.360505924 | 4.22373E−05 |
| 23 | 0.000159095 | 14.02530793 | 0.558357566 | 5.49707E−05 |
| 24 | 3.85269E−05 | 12.50006885 | 0.222286151 | 3.77629E−05 |
| 25 | 0.000126872 | 14.68630033 | 0.533227336 | 4.48928E−05 |
| 26 | 0.000210364 | 11.14069809 | 0.970314241 | 5.24778E−05 |
| 27 | 5.09001E−05 | 9.929157627 | 0.352299807 | 4.009E−05 |
| 28 | 0.000168829 | 8.070722319 | 1.537844434 | 3.71193E−05 |
| 29 | 0.000363844 | 10.16043742 | 0.671293443 | 0.000146293 |

TABLE 1c-continued Output from immunogenicity analyses

| position | totalscore | mhcscore | tapscore | proteasomescore |
|---|---|---|---|---|
| 30 | 2.06189E−05 | 11.66574302 | 0.127912329 | 3.82109E−05 |
| 31 | 0.022132896 | 17.65681657 | 16.1032081 | 0.000209655 |
| 32 | 0.027879223 | 8.84937105 | 2.494091632 | 0.003429894 |
| 33 | 0.000123359 | 11.14069809 | 0.641080261 | 4.68999E−05 |
| 34 | 0.000806311 | 20.74495061 | 1.891961982 | 5.6086E−05 |
| 35 | 0.000356829 | 11.14069809 | 1.806809666 | 4.82049E−05 |
| 36 | 0.00055883 | 18.4889567 | 1.308917895 | 6.21902E−05 |
| 37 | 0.00163762 | 14.68630033 | 2.734717094 | 0.00010891 |
| 38 | 0.000115249 | 22.22861507 | 0.336443704 | 4.12917E−05 |
| 39 | 0.000191343 | 7.88701025 | 1.765681657 | 3.74729E−05 |
| 40 | 0.000491116 | 6.712934432 | 1.537844434 | 0.000129807 |
| 41 | 0.000677471 | 18.06809666 | 1.166574302 | 8.70739E−05 |
| 42 | 3.36856E−05 | 11.14069809 | 0.207449506 | 3.88118E−05 |
| 43 | 0.00014483 | 21.22816259 | 0.377496044 | 4.85281E−05 |
| 44 | 0.003264254 | 7.360586237 | 2.93030216 | 0.000402442 |
| 45 | 0.000140007 | 7.707479979 | 1.402530793 | 3.521E−05 |
| 46 | 3.62244E−05 | 11.40019829 | 0.232762174 | 3.73826E−05 |
| 47 | 0.000348616 | 16.1032081 | 1.339406509 | 4.33022E−05 |
| 48 | 0.004074612 | 34.42804843 | 3.774960444 | 8.44971E−05 |
| 49 | 0.001131584 | 11.66574302 | 2.122816259 | 0.000123023 |
| 50 | 0.002085286 | 19.81127403 | 3.213012427 | 8.89479E−05 |
| 51 | 4.51837E−05 | 10.39710441 | 0.32878531 | 3.62723E−05 |
| 52 | 3.03008E−05 | 14.68630033 | 0.114001983 | 4.98593E−05 |
| 53 | 3.76548E−05 | 10.88710484 | 0.261163455 | 3.596E−05 |
| 54 | 0.001659218 | 2.79123286 | 4.139161818 | 8.50937E−05 |
| 55 | 0.000149148 | 14.02530793 | 0.545647796 | 5.22381E−05 |
| 56 | 0.004171506 | 12.50006885 | 1.166574302 | 0.000776349 |
| 57 | 0.006443566 | 14.35199932 | 2.611634549 | 0.000465797 |
| 58 | 3.34281E−05 | 14.68630033 | 0.133940651 | 4.56139E−05 |
| 59 | 0.037127736 | 11.93747308 | 16.1032081 | 0.00052448 |
| 60 | 0.00663909 | 19.81127403 | 3.952868849 | 0.000229639 |
| 61 | 0.006458684 | 9.266429059 | 2.494091632 | 0.000758499 |
| 62 | 0.000340528 | 20.27273789 | 0.702930528 | 6.40334E−05 |
| 63 | 0.002881924 | 17.65681657 | 2.494091632 | 0.000178119 |
| 64 | 7.61656E−05 | 14.68630033 | 0.336443704 | 4.10584E−05 |
| 65 | 0.000209237 | 7.88701025 | 1.140019829 | 6.41994E−05 |
| 66 | 0.005967534 | 9.703142406 | 3.364437037 | 0.000493477 |
| 67 | 0.001955737 | 9.266429059 | 2.552186489 | 0.000221532 |
| 68 | 0.017604909 | 20.27273789 | 29.98557666 | 7.89816E−05 |
| 69 | 8.35826E−05 | 11.14069809 | 0.558357566 | 3.65261E−05 |
| 70 | 0.002594439 | 19.36031438 | 2.172263001 | 0.000165466 |
| 71 | 3.00088E−05 | 16.86212891 | 0.122155325 | 3.90383E−05 |
| 72 | 0.000919044 | 11.66574302 | 2.027273789 | 0.000106306 |
| 73 | 0.000624075 | 10.88710484 | 2.494091632 | 6.17683E−05 |
| 74 | 6.33881E−05 | 11.40019829 | 0.249409163 | 6.13181E−05 |
| 75 | 0.000697186 | 9.929157627 | 2.672467333 | 7.11732E−05 |
| 76 | 0.015140398 | 10.39710441 | 7.360586237 | 0.000539173 |
| 77 | 6.53066E−05 | 16.86212891 | 0.19811274 | 5.41402E−05 |
| 78 | 0.312040853 | 26.72467333 | 42.35575283 | 0.000759428 |
| 79 | 0.344490583 | 12.79123286 | 27.98416838 | 0.002643626 |
| 80 | 0.178480054 | 26.11634549 | 5.210895997 | 0.003561048 |
| 81 | 1.717661138 | 12.21553255 | 21.72263001 | 0.017177042 |
| 82 | 0.001404259 | 20.74495061 | 0.671293443 | 0.000273623 |
| 83 | 0.000277344 | 13.39406509 | 1.468630033 | 3.83701E−05 |
| 84 | 0.145284018 | 12.50006885 | 5.98290911 | 0.005274918 |
| 85 | 0.052307569 | 15.73665433 | 7.532036315 | 0.001198564 |
| 86 | 0.000858248 | 9.482271919 | 2.274638603 | 0.000108393 |
| 87 | 0.007596331 | 13.39406509 | 0.172548984 | 0.008925249 |
| 88 | 0.000542897 | 16.86212891 | 0.992915763 | 8.77791E−05 |
| 89 | 0.000238301 | 8.258713592 | 1.686212891 | 4.70592E−05 |
| 90 | 0.006680505 | 9.929157627 | 1.502838821 | 0.001238526 |
| 91 | 6.22969E−05 | 15.73665433 | 0.267246733 | 4.00927E−05 |
| 92 | 0.000881673 | 23.81839017 | 0.702930528 | 0.000142668 |
| 93 | 0.011560202 | 14.35199932 | 1.725489835 | 0.001248935 |
| 94 | 5.48864E−05 | 22.22861507 | 0.184889567 | 3.67735E−05 |
| 95 | 6.20843E−05 | 13.70605295 | 0.32878531 | 3.78829E−05 |
| 96 | 0.000404981 | 8.84937105 | 2.552186489 | 4.90042E−05 |
| 97 | 2.28667E−05 | 14.35199932 | 0.122155325 | 3.5317E−05 |
| 98 | 0.000413407 | 14.02530793 | 1.891961982 | 4.16191E−05 |
| 99 | 0.000498189 | 9.266429059 | 2.611634549 | 5.58373E−05 |
| 100 | 7.19144E−05 | 15.37844434 | 0.313987533 | 4.02088E−05 |
| 101 | 0.000134928 | 8.070722319 | 1.250006885 | 3.66345E−05 |
| 102 | 0.001767121 | 10.16043742 | 1.84889567 | 0.000253395 |
| 103 | 0.000489226 | 16.4783 | 1.686212891 | 4.78379E−05 |
| 104 | 0.000140668 | 17.25489835 | 0.464421595 | 4.76012E−05 |
| 105 | 0.489070827 | 0.68403046 | 29.3030216 | 0.001466533 |

TABLE 1c-continued

Output from immunogenicity analyses

| position | totalscore | mhcscore | tapscore | proteasomescore |
|---|---|---|---|---|
| 106 | 0.001456535 | 13.39406509 | 1.016043742 | 0.000286335 |
| 107 | 0.031214534 | 14.68630033 | 3.862890569 | 0.001494362 |
| 108 | 0.000379244 | 6.264874929 | 1.725489835 | 9.6805E-05 |
| 109 | 0.002898725 | 11.66574302 | 1.686212891 | 0.000399516 |
| 110 | 0.014553946 | 9.482271919 | 2.437319175 | 0.001712156 |
| 111 | 7.03894E-05 | 12.21553255 | 0.423557528 | 3.71112E-05 |
| 112 | 9.96662E-05 | 13.08917895 | 0.584672147 | 3.58761E-05 |
| 113 | 0.001309179 | 11.66574302 | 2.552186489 | 0.000120062 |
| 114 | 0.000377961 | 15.73665433 | 0.864793477 | 7.53049E-05 |
| 115 | 0.164165075 | 20.272737893 | 7.74960444 | 0.000583111 |
| 116 | 0.070071877 | 12.791232863 | 7.74960444 | 0.000394384 |
| 117 | 0.000102335 | 18.4889567 | 0.377496044 | 4.00326E-05 |
| 118 | 0.000736796 | 13.39406509 | 0.825871359 | 0.00018023 |
| 119 | 8.86678E-05 | 21.22816259 | 0.299855767 | 3.78003E-05 |
| 120 | 0.000604388 | 12.50006885 | 1.088710484 | 0.000120905 |
| 121 | 0.000474711 | 16.4783 | 1.166574302 | 6.72969E-05 |
| 122 | 8.14247E-05 | 12.50006885 | 0.279841684 | 6.27394E-05 |
| 123 | 0.005779158 | 13.39406509 | 3.139875335 | 0.000379657 |
| 124 | 0.000168565 | 13.08917895 | 0.368903185 | 9.40827E-05 |
| 125 | 0.000141599 | 7.707479979 | 1.279123286 | 3.8882E-05 |
| 126 | 0.000109895 | 18.06809666 | 0.232762174 | 7.09543E-05 |
| 127 | 0.004081875 | 13.08917895 | 7.029305285 | 0.000120226 |
| 128 | 7.74925E-05 | 12.50006885 | 0.423557528 | 3.95401E-05 |
| 129 | 0.000199484 | 12.50006885 | 1.039710441 | 4.15659E-05 |
| 130 | 0.004654394 | 22.22861507 | 2.494091632 | 0.000231783 |
| 131 | 0.000117283 | 11.40019829 | 0.736058624 | 3.76417E-05 |
| 132 | 0.00250937 | 16.4783 | 1.806809666 | 0.000226837 |
| 133 | 0.000243602 | 11.66574302 | 1.435199932 | 3.90759E-05 |
| 134 | 2.0194E-05 | 11.93747308 | 0.122155325 | 3.74976E-05 |
| 135 | 0.00240769 | 23.81839017 | 3.952868849 | 6.94385E-05 |
| 136 | 7.18825E-05 | 13.39406509 | 0.2172263 | 6.62302E-05 |
| 137 | 0.000671558 | 15.37844434 | 1.221553255 | 9.76814E-05 |
| 138 | 0.029149146 | 12.79123286 | 2.552186489 | 0.002447701 |
| 139 | 0.000108191 | 19.81127403 | 0.202727379 | 7.34916E-05 |
| 140 | 0.000380177 | 14.35199932 | 1.61032081 | 4.46669E-05 |
| 141 | 0.042994713 | 19.36031438 | 5.092281523 | 0.001177354 |
| 142 | 0.597914802 | 11.66574302 | 36.05059237 | 0.003851289 |
| 143 | 0.000525873 | 11.40019829 | 1.64783 | 7.55946E-05 |
| 144 | 0.000425877 | 9.703142406 | 2.274638603 | 5.15599E-05 |
| 145 | 9.51453E-05 | 11.14069809 | 0.48630911 | 4.83954E-05 |
| 146 | 0.000114282 | 13.08917895 | 0.558357566 | 4.28532E-05 |
| 147 | 0.000384603 | 13.70605295 | 1.166574302 | 6.50063E-05 |
| 148 | 0.013888653 | 26.72467333 | 5.713633843 | 0.000249234 |
| 149 | 0.000207884 | 11.40019829 | 0.497636704 | 0.000101384 |
| 150 | 0.072692591 | 21.22816259 | 4.644215946 | 0.001979696 |
| 151 | 9.13848E-05 | 8.451083744 | 0.598290911 | 4.90765E-05 |
| 152 | 0.000194321 | 18.91961982 | 0.686929876 | 4.05995E-05 |
| 153 | 0.000147665 | 13.39406509 | 0.598290911 | 4.97643E-05 |
| 154 | 5.96976E-05 | 12.21553255 | 0.313987533 | 4.2448E-05 |
| 155 | 0.000304364 | 10.39710441 | 1.64783 | 4.72171E-05 |
| 156 | 0.000232098 | 14.02530793 | 0.736058624 | 6.09429E-05 |
| 157 | 4.49655E-05 | 9.055499382 | 0.321301243 | 4.26164E-05 |
| 158 | 0.001052342 | 14.02530793 | 2.672467333 | 7.64658E-05 |
| 159 | 0.002645292 | 15.73665433 | 2.734717094 | 0.000166845 |
| 160 | 0.019386533 | 18.06809666 | 27.98416838 | 0.000104775 |
| 161 | 0.000112838 | 32.13012427 | 0.255218649 | 3.72481E-05 |
| 162 | 0.419893137 | 15.73665433 | 21.72263001 | 0.003405842 |
| 163 | 0.000458265 | 14.68630033 | 2.074495061 | 4.12016E-05 |
| 164 | 0.054611893 | 10.16043742 | 2.611634549 | 0.005646639 |
| 165 | 5.99504E-05 | 19.36031438 | 0.189196198 | 4.45628E-05 |
| 166 | 0.001318468 | 16.4783 | 1.063928408 | 0.000205305 |
| 167 | 0.002095732 | 11.93747308 | 2.734717094 | 0.000173505 |
| 168 | 0.000184796 | 16.1032081 | 0.395286885 | 8.01508E-05 |
| 169 | 0.000275482 | 16.86212891 | 0.884937105 | 4.99016E-05 |
| 170 | 0.000167236 | 12.79123286 | 0.321301243 | 0.000110242 |
| 171 | 0.000342173 | 8.451083744 | 1.981127403 | 5.5619E-05 |
| 172 | 8.79781E-05 | 10.39710441 | 0.509228152 | 4.60152E-05 |
| 173 | 0.000211548 | 12.50006885 | 0.992915763 | 4.64314E-05 |
| 174 | 0.032232237 | 18.91961982 | 24.94091632 | 0.00018851 |
| 175 | 6.05564E-05 | 10.39710441 | 0.395286885 | 4.00369E-05 |
| 176 | 0.000998841 | 15.37844434 | 2.222861507 | 7.93173E-05 |
| 177 | 0.000264653 | 7.193038838 | 1.765681657 | 5.59102E-05 |
| 178 | 0.000139596 | 9.482271919 | 0.261163455 | 0.000152375 |
| 179 | 0.000296116 | 21.22816259 | 0.970314241 | 3.91975E-05 |
| 180 | 0.000327858 | 13.08917895 | 0.807072232 | 8.48754E-05 |
| 181 | 0.000152819 | 34.42804843 | 0.306840305 | 3.93781E-05 |

TABLE 1c-continued

Output from immunogenicity analyses

| position | totalscore | mhcscore | tapscore | proteasomescore |
|---|---|---|---|---|
| 182 | 0.098588371 | 16.4783 | 23.27621742 | 0.000703772 |
| 183 | 5.50708E-05 | 10.16043742 | 0.344280484 | 4.24145E-05 |
| 184 | 0.000330822 | 15.02838821 | 0.598290911 | 9.79903E-05 |
| 185 | 0.001918516 | 11.40019829 | 10.63928408 | 4.24955E-05 |
| 186 | 0.017374938 | 24.94091632 | 3.442804843 | 0.000549449 |
| 187 | 0.079255802 | 9.055499382 | 2.222861507 | 0.010928806 |
| 188 | 7.19099E-05 | 13.70605295 | 0.313987533 | 4.57906E-05 |
| 189 | 0.002203253 | 14.02530793 | 2.274638603 | 0.000187553 |
| 190 | 0.000119875 | 6.869298762 | 1.221553255 | 3.8427E-05 |
| 191 | 7.12456E-05 | 11.66574302 | 0.395286885 | 4.19525E-05 |
| 192 | 4.19024E-05 | 11.66574302 | 0.184889567 | 5.21066E-05 |
| 193 | 0.466489514 | 24.37319175 | 3.862890569 | 0.013431024 |
| 194 | 3.82148E-05 | 10.16043742 | 0.286360034 | 3.59508E-05 |
| 195 | 0.070447558 | 16.4783 | 3.068403046 | 0.003829724 |
| 196 | 0.003421942 | 15.37844434 | 7.360586237 | 8.21109E-05 |
| 197 | 0.001734764 | 16.86212891 | 4.235575283 | 6.57536E-05 |
| 198 | 7.34401E-05 | 13.39406509 | 0.433423451 | 3.46408E-05 |
| 199 | 0.055210676 | 21.22816259 | 19.81127403 | 0.00035693 |
| 200 | 0.001170004 | 20.27273789 | 1.039710441 | 0.000150667 |
| 201 | 0.010369934 | 19.81127403 | 0.970314241 | 0.001476792 |
| 202 | 9.92438E-05 | 9.929157627 | 0.453850068 | 6.05564E-05 |
| 203 | 0.004408103 | 15.02838821 | 4.752393632 | 0.000167575 |
| 204 | 0.000153088 | 12.50006885 | 0.533227336 | 6.29582E-05 |
| 205 | 0.707008218 | 12.79123286 | 4.235575283 | 0.036236842 |
| 206 | 0.000782934 | 20.74495061 | 1.308917895 | 7.86962E-05 |
| 207 | 0.00011326 | 15.02838821 | 0.433423451 | 4.65875E-05 |
| 208 | 0.001393141 | 14.35199932 | 4.334234505 | 6.15443E-05 |
| 209 | 0.001849097 | 14.35199932 | 5.092281523 | 6.92015E-05 |
| 210 | 0.000271964 | 9.055499382 | 1.936031438 | 4.21008E-05 |
| 211 | 0.001399652 | 9.703142406 | 2.672467333 | 0.000146581 |
| 212 | 4.64163E-05 | 9.266429059 | 0.377496044 | 3.67224E-05 |
| 213 | 8.55306E-05 | 25.52186489 | 0.243731918 | 3.79314E-05 |
| 214 | 0.000156546 | 5.98290911 | 2.027273789 | 3.50463E-05 |
| 215 | 7.72511E-05 | 11.14069809 | 0.433423451 | 4.31182E-05 |
| 216 | 0.002519187 | 11.93747308 | 8.451083744 | 6.70433E-05 |
| 217 | 0.001880782 | 22.74638603 | 5.583575658 | 3.99758E-05 |
| 218 | 0.001112268 | 20.74495061 | 4.235575283 | 3.4321E-05 |
| 219 | 0.000864187 | 20.74495061 | 2.672467333 | 4.29883E-05 |
| 220 | 0.001042542 | 23.27621742 | 2.86360034 | 4.24353E-05 |
| 221 | 1.36926E-05 | 11.66574302 | 0.078870103 | 4.02562E-05 |
| 222 | 0.000575915 | 14.68630033 | 1.370605295 | 7.6655E-05 |
| 223 | 0.000671987 | 12.21553255 | 2.027273789 | 7.3438E-05 |
| 224 | 0.00481335 | 18.06809666 | 3.139875335 | 0.000230241 |
| 225 | 0.012382803 | 22.74638603 | 4.139161818 | 0.000357102 |
| 226 | 0.000433317 | 16.86212891 | 0.612226897 | 0.000113075 |
| 227 | 0.000137795 | 11.14069809 | 0.475239363 | 7.06695E-05 |
| 228 | 9.3886E-05 | 10.63928408 | 0.475239363 | 4.97657E-05 |
| 229 | 0.000313999 | 8.258713592 | 2.494091632 | 4.15932E-05 |
| 230 | 0.000210483 | 7.532036315 | 1.088710484 | 6.96074E-05 |
| 231 | 0.000114812 | 11.93747308 | 0.545647796 | 4.8006E-05 |
| 232 | 0.002931611 | 13.39406509 | 2.437319175 | 0.000245254 |
| 233 | 6.24704E-05 | 18.4889567 | 0.249409163 | 3.67897E-05 |
| 234 | 0.000224071 | 25.52186489 | 0.545647796 | 4.29359E-05 |
| 235 | 0.000140232 | 15.37844434 | 0.598290911 | 4.14082E-05 |
| 236 | 4.47327E-05 | 11.14069809 | 0.238183902 | 4.59548E-05 |
| 237 | 3.15174E-05 | 14.35199932 | 0.172548984 | 3.4879E-05 |
| 238 | 0.00185966 | 24.94091632 | 2.998557666 | 6.71063E-05 |
| 239 | 0.000178064 | 9.929157627 | 1.250006885 | 3.92323E-05 |
| 240 | 0.000131112 | 28.6360034 | 0.243731918 | 5.0291E-05 |
| 241 | 0.077185871 | 14.68630033 | 27.98416838 | 0.000509888 |
| 242 | 0.002460055 | 12.21553255 | 1.981127403 | 0.000276036 |
| 243 | 0.000266501 | 20.74495061 | 0.864793477 | 4.07598E-05 |
| 244 | 0.000595339 | 17.25489835 | 1.279123286 | 7.22179E-05 |
| 245 | 7.95906E-05 | 23.27621742 | 0.207449506 | 4.47518E-05 |
| 246 | 0.005975783 | 15.37844434 | 3.2878531 | 0.000318703 |
| 247 | 0.002012702 | 11.93747308 | 6.869298762 | 6.71892E-05 |
| 248 | 0.000702835 | 14.02530793 | 2.552186489 | 5.23388E-05 |
| 249 | 0.053096317 | 12.79123286 | 20.74495061 | 0.00054322 |
| 250 | 0.002184807 | 22.74638603 | 4.235575283 | 6.0935E-05 |
| 251 | 0.000338308 | 11.93747308 | 1.573665433 | 4.86469E-05 |
| 252 | 0.000244172 | 11.14069809 | 0.719303884 | 8.35599E-05 |
| 253 | 0.017365732 | 23.27621742 | 3.213012427 | 0.000631947 |
| 254 | 0.000381754 | 13.08917895 | 1.039710441 | 7.64048E-05 |
| 255 | 0.000239664 | 16.1032081 | 0.545647796 | 7.52696E-05 |
| 256 | 0.000165229 | 13.70605295 | 0.533227336 | 6.1892E-05 |
| 257 | 0.572826298 | 17.25489835 | 2.274638603 | 0.039630115 |

TABLE 1c-continued

| Output from immunogenicity analyses | | | | |
|---|---|---|---|---|
| position | totalscore | mhcscore | tapscore | proteasomescore |
| 258 | 0.000443714 | 15.02838821 | 0.992915763 | 7.97373E−05 |
| 259 | 0.000717834 | 19.36031438 | 1.936031438 | 5.12357E−05 |
| 260 | 0.00035004 | 11.66574302 | 0.992915763 | 8.13609E−05 |
| 261 | 0.003980082 | 21.22816259 | 4.644215946 | 0.000109751 |
| 262 | 0.004494006 | 13.08917895 | 2.074495061 | 0.000452661 |
| 263 | 0.00032321 | 33.64437037 | 0.306840305 | 8.49517E−05 |
| 264 | 0.000597681 | 15.37844434 | 0.736058624 | 0.000141442 |
| 265 | 0.083606849 | 23.27621742 | 4.435191796 | 0.002199125 |
| 266 | 0.000248454 | 6.869298762 | 2.274638603 | 4.28948E−05 |
| 267 | 0.003448544 | 15.02838821 | 2.798416838 | 0.000221445 |
| 268 | 0.230806121 | 14.35199932 | 2.274638603 | 0.019197571 |
| 269 | 0.005793992 | 28.6360034 | 4.235575283 | 0.000132201 |
| 270 | 0.000141299 | 15.37844434 | 0.44351918 | 5.65689E−05 |
| 271 | 0.007550977 | 19.36031438 | 2.027273789 | 0.000522164 |
| 272 | 0.028153555 | 10.639284082 | 0.27273789 | 0.000349045 |
| 273 | 8.07637E−05 | 11.40019829 | 0.321301243 | 5.95633E−05 |
| 274 | 0.00237182 | 11.66574302 | 2.074495061 | 0.000260883 |
| 275 | 0.062347981 | 8.258713592 | 2.734717094 | 0.007492655 |
| 276 | 0.003912558 | 21.22816259 | 4.334234505 | 0.000116891 |
| 277 | 3.27487E−05 | 13.70605295 | 0.168621289 | 3.88351E−05 |
| 278 | 0.000180456 | 14.35199932 | 0.238183902 | 0.000140977 |
| 279 | 0.083163946 | 16.862128913 | 7.74960444 | 0.000355677 |
| 280 | 0.001253422 | 9.055499382 | 0.788701025 | 0.00046667 |
| 281 | 0.000194038 | 11.93747308 | 1.140019829 | 3.91682E−05 |
| 282 | 5.68186E−05 | 17.65681657 | 0.176568166 | 5.00244E−05 |
| 283 | 0.002179164 | 13.70605295 | 1.221553255 | 0.000361179 |
| 284 | 0.010480433 | 16.86212891 | 4.976367043 | 0.000339565 |
| 285 | 0.000207057 | 13.70605295 | 0.475239363 | 8.56867E−05 |
| 286 | 0.000128927 | 10.63928408 | 0.656012939 | 4.98499E−05 |
| 287 | 0.000302888 | 16.1032081 | 0.864793477 | 5.93561E−05 |
| 288 | 4.6263E−05 | 10.39710441 | 0.202727379 | 5.86939E−05 |
| 289 | 0.001354597 | 13.70605295 | 3.52299807 | 7.58072E−05 |
| 290 | 0.000618642 | 8.647934772 | 2.672467333 | 7.19199E−05 |
| 291 | 0.001887329 | 18.06809666 | 1.936031438 | 0.000147404 |
| 292 | 0.0004937 | 17.25489835 | 0.753203631 | 0.000101778 |
| 293 | 0.001616446 | 29.3030216 | 3.068403046 | 4.9181E−05 |
| 294 | 0.068465492 | 12.21553255 | 6.264874929 | 0.002429746 |
| 295 | 0.000451584 | 18.06809666 | 1.016043742 | 6.58369E−05 |
| 296 | 0.004368096 | 17.25489835 | 1.166574302 | 0.000589091 |
| 297 | 0.001490968 | 13.70605295 | 2.734717094 | 0.000106171 |
| 298 | 0.028951999 | 17.65681657 | 1.279123286 | 0.003477998 |
| 299 | 0.001152281 | 11.40019829 | 3.139875335 | 8.74717E−05 |
| 300 | 0.026971311 | 14.68630033 | 2.327621742 | 0.002190423 |
| 301 | 9.6134E−05 | 16.1032081 | 0.404494299 | 4.04506E−05 |
| 302 | 0.000130133 | 15.02838821 | 0.464421595 | 5.08676E−05 |
| 303 | 0.005604023 | 10.63928408 | 3.364437037 | 0.000434532 |
| 304 | 0.000421245 | 14.02530793 | 2.027273789 | 4.08524E−05 |
| 305 | 0.001977786 | 21.22816259 | 5.583575658 | 4.52103E−05 |
| 306 | 0.002425573 | 18.06809666 | 5.846721472 | 6.16713E−05 |
| 307 | 0.000624884 | 15.73665433 | 1.250006885 | 8.71442E−05 |
| 308 | 0.000333609 | 6.869298762 | 2.327621742 | 5.60145E−05 |
| 309 | 0.000142043 | 11.66574302 | 0.598290911 | 5.41275E−05 |
| 310 | 0.000325791 | 12.21553255 | 1.84889567 | 3.96374E−05 |
| 311 | 0.000551644 | 15.73665433 | 0.992915763 | 9.51103E−05 |
| 312 | 0.000100483 | 16.86212891 | 0.404494299 | 3.9605E−05 |
| 313 | 5.66848E−05 | 13.08917895 | 0.267246733 | 4.48192E−05 |
| 314 | 7.52759E−05 | 11.66574302 | 0.453850068 | 3.89212E−05 |
| 315 | 0.000315848 | 7.029305285 | 3.213012427 | 3.73045E−05 |
| 316 | 0.001489085 | 11.14069809 | 3.52299807 | 0.000101478 |
| 317 | 0.000160787 | 12.79123286 | 0.948227192 | 3.61294E−05 |
| 318 | 7.65189E−05 | 16.86212891 | 0.336443704 | 3.62734E−05 |
| 319 | 6.90281E−05 | 16.4783 | 0.255218649 | 4.45683E−05 |
| 320 | 4.75538E−05 | 8.647934772 | 0.404494299 | 3.71925E−05 |
| 321 | 0.000355948 | 16.86212891 | 1.308917895 | 4.29815E−05 |
| 322 | 0.000202312 | 10.39710441 | 1.502838821 | 3.53275E−05 |
| 323 | 0.227356053 | 12.79123286 | 36.05059237 | 0.001327589 |
| 324 | 9.01036E−05 | 14.02530793 | 0.395286885 | 4.48419E−05 |
| 325 | 0.000225325 | 15.73665433 | 0.612226897 | 6.36963E−05 |
| 326 | 0.004941774 | 20.74495061 | 2.998557666 | 0.000216414 |
| 327 | 0.01326492 | 12.21553255 | 2.027273789 | 0.00142922 |
| 328 | 0.003718088 | 23.81839017 | 3.689031854 | 0.000113968 |
| 329 | 0.004167344 | 15.37844434 | 0.884937105 | 0.000832679 |
| 330 | 0.000131618 | 11.14069809 | 0.558357566 | 5.63909E−05 |
| 331 | 4.56581E−05 | 9.482271919 | 0.255218649 | 5.12428E−05 |
| 332 | 7.20774E−05 | 12.50006885 | 0.352299807 | 4.45916E−05 |
| 333 | 0.034758616 | 10.63928408 | 2.734717094 | 0.003243739 |

TABLE 1c-continued

| | Output from immunogenicity analyses | | | |
|---|---|---|---|---|
| position | totalscore | mhcscore | tapscore | proteasomescore |
| 334 | 0.001279068 | 16.1032081 | 1.339406509 | 0.000164095 |
| 335 | 0.0067709 | 15.37844434 | 10.16043742 | 0.000117995 |
| 336 | 0.000241151 | 9.266429059 | 1.806809666 | 3.87283E-05 |
| 337 | 0.000881043 | 11.93747308 | 2.027273789 | 9.85572E-05 |
| 338 | 0.001402766 | 22.74638603 | 2.222861507 | 7.59423E-05 |
| 339 | 0.000155937 | 17.25489835 | 0.584672147 | 4.12205E-05 |
| 340 | 0.000102855 | 26.72467333 | 0.286360034 | 3.63759E-05 |
| 341 | 0.029541969 | 16.4783 | 6.122268966 | 0.000795475 |
| 342 | 0.010547896 | 9.055499382 | 32.13012427 | 9.92001E-05 |
| 343 | 0.00104485 | 12.50006885 | 3.139875335 | 7.3512E-05 |
| 344 | 0.003614546 | 8.84937105 | 2.274638603 | 0.000497764 |
| 345 | 0.001856153 | 15.73665433 | 2.86360034 | 0.000112033 |
| 346 | 0.000199744 | 8.451083744 | 1.61032081 | 3.99152E-05 |
| 347 | 3.08138E-05 | 8.647934772 | 0.255218649 | 3.76999E-05 |
| 348 | 0.000222023 | 9.703142406 | 1.250006885 | 5.02243E-05 |
| 349 | 8.82657E-05 | 11.66574302 | 0.453850068 | 4.50325E-05 |
| 350 | 2.57735E-05 | 10.88710484 | 0.172548984 | 3.69963E-05 |
| 351 | 4.03044E-05 | 13.39406509 | 0.19811274 | 4.13067E-05 |
| 352 | 0.004566689 | 9.482271919 | 3.605059237 | 0.000362474 |
| 353 | 0.001055758 | 13.08917895 | 5.210895997 | 4.20808E-05 |
| 354 | 3.05164E-05 | 10.88710484 | 0.2172263 | 3.53289E-05 |
| 355 | 0.002585554 | 27.34717094 | 2.998557666 | 8.70808E-05 |
| 356 | 0.000139406 | 12.21553255 | 0.702930528 | 4.36022E-05 |
| 357 | 0.003081322 | 22.22861507 | 2.327621742 | 0.000163677 |
| 358 | 0.000205076 | 14.68630033 | 0.558357566 | 6.72774E-05 |
| 359 | 0.000146209 | 33.64437037 | 0.32878531 | 3.61733E-05 |
| 360 | 0.012689615 | 12.21553255 | 25.52186489 | 0.000112607 |
| 361 | 0.004583891 | 16.4783 | 4.752393632 | 0.000158805 |
| 362 | 0.000214841 | 7.360586237 | 1.468630033 | 5.37078E-05 |
| 363 | 0.007450718 | 18.91961982 | 2.494091632 | 0.000428744 |
| 364 | 0.106193293 | 10.88710484 | 3.364437037 | 0.008050725 |
| 365 | 6.36614E-05 | 12.50006885 | 0.368903185 | 3.78588E-05 |
| 366 | 3.36424E-05 | 15.02838821 | 0.157366543 | 3.92244E-05 |
| 367 | 6.81265E-05 | 10.63928408 | 0.453850068 | 3.83103E-05 |
| 368 | 6.02667E-05 | 10.16043742 | 0.344280484 | 4.64704E-05 |
| 369 | 0.015366884 | 10.88710484 | 2.93030216 | 0.001306252 |
| 370 | 0.041789394 | 19.36031438 | 25.52186489 | 0.000230784 |
| 371 | 0.000222478 | 15.73665433 | 0.864793477 | 4.34986E-05 |
| 372 | 0.005150502 | 17.25489835 | 2.494091632 | 0.000326126 |
| 373 | 8.00509E-05 | 9.482271919 | 0.360505924 | 6.48627E-05 |
| 374 | 6.63686E-05 | 22.22861507 | 0.212281626 | 3.81911E-05 |
| 375 | 7.50907E-05 | 12.21553255 | 0.44351918 | 3.70893E-05 |
| 376 | 0.001539591 | 13.39406509 | 1.468630033 | 0.000212993 |
| 377 | 0.130153448 | 18.4889567 | 29.3030216 | 0.000651829 |
| 378 | 0.012114767 | 18.06809666 | 0.992915763 | 0.001833678 |
| 379 | 7.85619E-05 | 10.63928408 | 0.413916182 | 4.87707E-05 |
| 380 | 0.001795076 | 16.86212891 | 3.2878531 | 8.70516E-05 |
| 381 | 0.000130478 | 8.451083744 | 1.039710441 | 4.08208E-05 |
| 382 | 0.00011804 | 7.029305285 | 1.114069809 | 4.04629E-05 |
| 383 | 0.001199255 | 11.14069809 | 0.864793477 | 0.000337446 |
| 384 | 0.00076988 | 16.4783 | 1.537844434 | 8.24444E-05 |
| 385 | 0.000328129 | 11.66574302 | 1.402530793 | 5.43864E-05 |
| 386 | 0.001878249 | 23.27621742 | 1.806809666 | 0.000121176 |
| 387 | 0.000949237 | 22.74638603 | 0.948227192 | 0.000119569 |
| 388 | 0.000322352 | 11.93747308 | 0.686929876 | 0.000108257 |
| 389 | 9.70649E-05 | 10.88710484 | 0.686929876 | 3.58878E-05 |
| 390 | 5.56156E-05 | 21.22816259 | 0.184889567 | 3.84766E-05 |
| 391 | 0.000301138 | 14.02530793 | 0.825871359 | 7.01035E-05 |
| 392 | 0.00023197 | 19.36031438 | 0.464421595 | 6.96021E-05 |
| 393 | 0.086167577 | 13.08917895 | 42.35575283 | 0.000428099 |
| 394 | 0.00320585 | 20.74495061 | 4.752393632 | 8.8303E-05 |
| 395 | 0.000356753 | 14.02530793 | 1.140019829 | 6.04461E-05 |
| 396 | 0.003535662 | 11.66574302 | 2.611634549 | 0.000315439 |
| 397 | 0.00014032 | 16.4783 | 0.386289057 | 5.92625E-05 |
| 398 | 0.004866363 | 12.50006885 | 14.68630033 | 7.28681E-05 |
| 399 | 0.000158366 | 23.81839017 | 0.273471709 | 6.59099E-05 |
| 400 | 0.001939939 | 8.647934772 | 3.2878531 | 0.000185328 |
| 401 | 0.074518819 | 16.1032081 | 1.936031438 | 0.006598619 |
| 402 | 0.000368539 | 16.4783 | 0.970314241 | 6.18047E-05 |
| 403 | 0.00019918 | 8.070722319 | 1.725489835 | 3.91329E-05 |
| 404 | 0.0023339 | 14.35199932 | 3.52299807 | 0.000125363 |
| 405 | 0.000307937 | 10.16043742 | 2.074495061 | 3.99055E-05 |
| 406 | 4.35479E-05 | 8.070722319 | 0.344280484 | 4.25484E-05 |
| 407 | 0.009636643 | 10.63928408 | 15.37844434 | 0.000162331 |
| 408 | 0.000704922 | 12.79123286 | 1.64783 | 9.09555E-05 |
| 409 | 0.082073394 | 13.39406509 | 3.139875335 | 0.005307281 |

TABLE 1c-continued

Output from immunogenicity analyses

| position | totalscore | mhcscore | tapscore | proteasomescore |
|---|---|---|---|---|
| 410 | 0.000172874 | 11.14069809 | 0.612226897 | 6.78625E−05 |
| 411 | 0.002590415 | 20.74495061 | 5.713633843 | 5.95983E−05 |
| 412 | 2.14123E−05 | 10.16043742 | 0.114001983 | 5.01741E−05 |
| 413 | 1.79079E−05 | 12.50006885 | 0.103971044 | 3.74308E−05 |
| 414 | 0.015229974 | 16.4783 | 7.532036315 | 0.000340591 |
| 415 | 0.001564252 | 5.456477959 | 2.93030216 | 0.000265267 |
| 416 | 7.42737E−05 | 24.94091632 | 0.232762174 | 3.46397E−05 |
| 417 | 0.002017239 | 12.50006885 | 2.437319175 | 0.000179922 |
| 418 | 0.001073996 | 14.02530793 | 3.2878531 | 6.32416E−05 |
| 419 | 0.000103914 | 24.37319175 | 0.321301243 | 3.60307E−05 |
| 420 | 0.00227239 | 15.02838821 | 5.210895997 | 7.79872E−05 |
| 421 | 0.003094582 | 17.65681657 | 5.846721472 | 8.01705E−05 |
| 422 | 0.026822594 | 11.14069809 | 24.37319175 | 0.000263402 |
| 423 | 8.06153E−05 | 17.25489835 | 0.321301243 | 3.90039E−05 |
| 424 | 6.65435E−05 | 15.02838821 | 0.313987533 | 3.80554E−05 |
| 425 | 8.68244E−05 | 12.50006885 | 0.413916182 | 4.61813E−05 |
| 426 | 5.02296E−05 | 9.482271919 | 0.377496044 | 3.7914E−05 |
| 427 | 0.005633169 | 13.39406509 | 15.73665433 | 7.26803E−05 |
| 428 | 0.053561311 | 10.88710484 | 2.611634549 | 0.005001157 |
| 429 | 0.000211193 | 7.360586237 | 1.981127403 | 3.98133E−05 |
| 430 | 0.128441705 | 12.50006885 | 15.02838821 | 0.001895798 |
| 431 | 0.00032307 | 9.482271919 | 1.537844434 | 6.04888E−05 |
| 432 | 0.010134136 | 23.81839017 | 16.4783 | 6.92222E−05 |
| 433 | 7.69896E−05 | 13.70605295 | 0.377496044 | 4.06321E−05 |
| 434 | 0.000135597 | 22.22861507 | 0.377496044 | 4.37181E−05 |
| 435 | 0.001444653 | 14.68630033 | 4.644215946 | 5.67292E−05 |
| 436 | 8.44475E−05 | 14.02530793 | 0.336443704 | 4.85387E−05 |
| 437 | 0.000172682 | 15.02838821 | 0.788701025 | 4.02947E−05 |
| 438 | 0.043302564 | 22.22861507 | 4.334234505 | 0.001237471 |
| 439 | 0.00083712 | 19.81127403 | 1.140019829 | 0.000100867 |
| 440 | 0.110359565 | 17.25489835 | 23.81839017 | 0.000713841 |
| 441 | 0.00239921 | 15.02838821 | 3.139875335 | 0.000138022 |
| 442 | 5.51714E−05 | 11.40019829 | 0.299855767 | 4.43098E−05 |
| 443 | 2.73416E−05 | 13.70605295 | 0.119374731 | 4.57706E−05 |
| 444 | 7.76194E−05 | 13.39406509 | 0.32878531 | 4.81237E−05 |
| 445 | 0.01841864 | 18.06809666 | 8.451083744 | 0.000326235 |
| 446 | 0.00091319 | 13.70605295 | 1.435199932 | 0.00012658 |
| 447 | 0.005087454 | 18.06809666 | 4.538500684 | 0.000169647 |
| 448 | 0.001545552 | 16.86212891 | 0.970314241 | 0.000258749 |
| 449 | 0.000120989 | 10.39710441 | 0.584672147 | 5.2939E−05 |
| 450 | 0.000949163 | 15.73665433 | 2.222861507 | 7.37358E−05 |
| 451 | 0.003519884 | 15.37844434 | 6.869298762 | 9.09167E−05 |
| 452 | 2.91528E−05 | 10.63928408 | 0.184889567 | 3.93474E−05 |
| 453 | 0.000259943 | 12.50006885 | 0.497636704 | 0.000114874 |
| 454 | 0.069613956 | 9.929157627 | 4.044942993 | 0.004814647 |
| 455 | 0.011539164 | 13.39406509 | 8.84937105 | 0.000266971 |
| 456 | 0.000245616 | 15.37844434 | 0.992915763 | 4.32175E−05 |
| 457 | 0.064510667 | 18.91961982 | 27.98416838 | 0.000328666 |
| 458 | 0.019758322 | 16.1032081 | 38.62890569 | 8.50784E−05 |
| 459 | 0.000992578 | 10.39710441 | 0.926642906 | 0.000279497 |
| 460 | 0.000162264 | 13.70605295 | 0.377496044 | 8.49288E−05 |
| 461 | 8.60808E−05 | 14.68630033 | 0.395286885 | 3.95986E−05 |
| 462 | 0.000100838 | 10.16043742 | 0.5210896 | 5.101E−05 |
| 463 | 0.026273224 | 22.74638603 | 6.712934432 | 0.000467224 |
| 464 | 0.003758225 | 13.70605295 | 3.52299807 | 0.000209698 |
| 465 | 0.000251714 | 14.02530793 | 0.948227192 | 5.16242E−05 |
| 466 | 0.210714099 | 20.74495061 | 15.37844434 | 0.001793468 |
| 467 | 0.015124482 | 16.86212891 | 18.4889567 | 0.000130494 |
| 468 | 0.001275927 | 18.91961982 | 2.381839017 | 7.7579E−05 |
| 469 | 0.005514392 | 20.74495061 | 2.494091632 | 0.000288274 |
| 470 | 0.156586151 | 18.4889567 | 6.410802613 | 0.003538119 |
| 471 | 0.186229111 | 14.35199932 | 2.998557666 | 0.011991882 |
| 472 | 0.042285785 | 28.6360034 | 5.210895997 | 0.000773999 |
| 473 | 0.650258534 | 12.21553255 | 44.35191796 | 0.003257705 |
| 474 | 0.144329762 | 25.52186489 | 5.210895997 | 0.002904785 |
| 475 | 0.002158857 | 16.4783 | 0.184889567 | 0.001965935 |
| 476 | 0.006971615 | 20.27273789 | 2.86360034 | 0.000330172 |
| 477 | 0.00402333 | 9.929157627 | 3.774960444 | 0.00029246 |
| 478 | 0.033812192 | 17.25489835 | 5.98290911 | 0.000880456 |
| 479 | 0.00023843 | 15.02838821 | 0.249409163 | 0.000173268 |
| 480 | 0.001645208 | 19.36031438 | 1.308917895 | 0.000179905 |
| 481 | 0.0484191 | 11.93747308 | 7.532036315 | 0.001430588 |
| 482 | 9.55314E−05 | 18.4889567 | 0.184889567 | 7.59792E−05 |
| 483 | 0.041845605 | 11.93747308 | 9.703142406 | 0.000984742 |
| 484 | 0.019450519 | 19.81127403 | 5.456477959 | 0.000480395 |
| 485 | 0.026711018 | 8.647934772 | 2.798416838 | 0.002995786 |

TABLE 1c-continued

Output from immunogenicity analyses

| position | totalscore | mhcscore | tapscore | proteasomescore |
|---|---|---|---|---|
| 486 | 0.002357911 | 18.4889567 | 2.437319175 | 0.000142909 |
| 487 | 0.421294865 | 33.64437037 | 25.52186489 | 0.001344337 |
| 488 | 0.025919091 | 16.1032081 | 30.68403046 | 0.000141309 |
| 489 | 0.00481277 | 27.34717094 | 0.433423451 | 0.001102531 |
| 490 | 0.005726208 | 9.266429059 | 5.98290911 | 0.000280416 |
| 491 | 0.016151725 | 15.37844434 | 3.862890569 | 0.000738517 |
| 492 | 0.000487614 | 7.360586237 | 3.442804843 | 5.22113E−05 |
| 493 | 0.061733956 | 29.3030216 | 6.410802613 | 0.000885952 |
| 494 | 0.001663264 | 19.81127403 | 1.502838821 | 0.000152943 |
| 495 | 0.066165089 | 11.40019829 | 19.81127403 | 0.000798045 |
| 496 | 0.014395555 | 15.37844434 | 14.68630033 | 0.000170788 |
| 497 | 0.009138115 | 16.4783 | 2.381839017 | 0.000638927 |
| 498 | 0.105623599 | 15.02838821 | 7.029305285 | 0.002777924 |
| 499 | 0.000110394 | 28.6360034 | 0.279841684 | 3.7797E−05 |
| 500 | 0.044368613 | 9.703142406 | 24.37319175 | 0.000512563 |
| 501 | 0.092445553 | 13.39406509 | 27.34717094 | 0.000694007 |
| 502 | 0.24858678 | 10.39710441 | 4.235575283 | 0.015327737 |
| 503 | 0.000134276 | 11.40019829 | 0.509228152 | 6.18108E−05 |
| 504 | 0.003680974 | 26.11634549 | 3.862890569 | 9.72953E−05 |

TABLE 2

Genes expressed predominately in the Retinal Ganglion Cell Layer (RGL). Genes expressed at least at 10 fold higher levels in the GCL than in other parts of the retina, as identified both by SAM and t-test, and grouped by putative function. Promoter sequences belonging to any of these genes would in drive high and preferential gene expression in GCL and may hence be utilised to drive expression of OphNDI1 contemplated in this patent application. In addition, additional genes expresses in addition to OphNDI1 such as those described in Table 6 may be expressed from any of these promoters. Table adapted from Kim et al., Mol Vis 2006; 12:1640-1646

| Transcriptional regulation and RNA binding molecules | ECM organisation |
|---|---|
| EBF | CTHRC1 |
| ERF5A2 | LAMA4 |
| ELAVL2 | SERPINE2 |
| ELAVL4 | Neuronal development |
| FKBP1B | CRTAC1 |
| KIAA1045 | GAP43 |
| POU4F1 | NRG1 |
| RBPMS | NRN1 |
| RBPMS2 | Fatty acid metabolism |
| TGFB1I1 | FABP3 |
| Cytoskeleton/Neurofilaments | LSS |
| EPPK1 | Signal transduction |
| KEF5A | GPR54 |
| MAP1A | RGS1 |
| MICAL2 | RGS5 |
| NEF3 | RIT2 |
| NEFH | Apoptosis |
| NEFL | IER3 |
| PRPH | LGALS1 |
| TMSB10 | TNFRSF21 |
| Endocytosis/neurotransmitter transport/synaptic transmission | Miscellaneous |
| ANXA2 | GGH |
| AP1G1 | HBA2 |
| CHRNB3 | HHL |
| CPLX1 | HLA-DPA1 |
| GNAS | LMO2 |
| QPRT | MT3 |
| RAB13 | PECAM1 |
| STMN2 | PPP2R2C |
| STXBP6 | UCHL1 |
| SYNGR3 | Cell adhesion |
| Ion/Anion transport | FAT3 |
| ATP1B1 | FN1 |
| KCNA2 | GJA1 |
| KCNJ8 | PCDH7 |
| SCN1A | SRPX |
| SCN1B | THY1 |
| SCN4B | |
| SLC17A6 | |
| SLC4A11 | |
| GABRB3 | |

TABLE 3

Transcripts detected at very high levels by gene array analyses of the human retinal ganglion cell layer (GCL). The genes listed here are likely to represent highly abundant transcripts of the ganglion cell layer. Promoter sequences belonging to any of these genes would in theory drive very high levels of gene expression in GCL and may hence be utilised to drive expression of OphNDI1 and the contemplated in this patent application. In addition, additional genes expresses in addition to OphNDI1 such as those described in Table 6 may be expressed from any of these promoters. Table adapted from Kim et al., Mol Vis 2006;12:1640-1646

| | |
|---|---|
| TF | H3F3A |
| TUBA3 | COX7A2 |
| NEFH | RTN1 |
| GABARAPL3 | CALM2 |
| TUBB | MAFF |
| GLUL | INA |
| UBB | PGK1 |
| NEFL | AF1Q |
| EIF3S6IP | YWHAB |
| PGAM1 | SUI1 |
| LDHA | DDAH1 |

TABLE 3-continued

Transcripts detected at very high levels by gene array analyses of the human retinal ganglion cell layer (GCL). The genes listed here are likely to represent highly abundant transcripts of the ganglion cell layer. Promoter sequences belonging to any of these genes would in theory drive very high levels of gene expression in GCL and may hence be utilised to drive expression of OphNDI1 and the contemplated in this patent application. In addition, additional genes expresses in addition to OphNDI1 such as those described in Table 6 may be expressed from any of these promoters.
Table adapted from Kim et al., Mol Vis 2006;12:1640-1646

| | |
|---|---|
| RTN4 | EIF4A2 |
| HINT1 | MAP1B |
| LDHB | NDUFB8 |
| PGR1 | K-ALPHA-1 |
| EEF1A1 | STK35 |
| PTPRO | NEF3 |
| SNAP25 | TMSB10 |
| FTH1 | DRLM |
| EEF1D | MGC14697 |
| SKP1A | FTL |
| BEX1 | CSRP2 |
| HSPA8 | SRP14 |
| PCP4 | CYCS |
| PARK7 | BNIP3 |
| MAP4 | LAMP1 |
| ACTG1 | WIF1 |
| CDIPT | MDH1 |
| VAMP1 | NARS |
| SMT3H2 | OAZ1 |
| EEF1G | STOM |
| COX5A | GNAS |
| SPARCL1 | NGFRAP1 |
| UBC | DBI |
| KARS | TSC22 |
| C6orf53 | ATP6V0E |
| VEGF | FDFT1 |
| COX4I1 | SAT |
| STMN2 | ATP5A1 |
| NPM1 | MTCH1 |
| APP | HIG1 |
| CIRBP | GPX3 |
| B2M | CFL1 |
| DP1 | MYL6 |
| LAPTM4B | SNCG |

TABLE 4

Exemplary universal promoters, inducible/conditional promoters, enhancer elements and epigenetic elements

| Promoters | Reference |
|---|---|
| chicken β-actin promoter | Miyazaki et al., Gene. 1989 July 15; 79(2):269-77. |
| SV40 promoter | Byrne et al., Proc Natl Acad Sci USA. 1983 February; 80(3):721-5. |
| CMV promoter | Thomsen et al., Proc Natl Acad Sci USA. 1984 February; 81(3):659-63. Schmidt et al., Mol Cell. Biol. August 1990 vol.10 no.8 4406-4411. Furth et al., Nucl Acids Res. (1991) 19(22):6205-6208. |
| Ubiquitin promoter | Schorpp et al., Nucl. Acids Res. (1996) 24 (9):1787-1788. |
| PGK promoter | McBurney et al., Dev Dyn. August 1994; 200(4):278-93. |
| Inducible Promoters | Reference |
| tetR | Steiger et al., 2007 |
| Enhancer Element | Reference |
| Chicken ovalbumin upstream promoter transcription factor II | Eguchi et al., Biochimie 89(3):278-88, 2007 |
| Mouse dystrophin muscle promoter/enhancer | Anderson et al., Mol. Ther. 14(5):724-34, 2006 |
| Tobacco eIF4A-10 promoter elements | Tian et al., J. Plant Physiol. 162(12):1355-66, 2005 |
| Immunoglobulin (Ig) enhancer element HS1, 2A | Frezza et al., Ann. Rheum. Dis. Mar. 28, 2007 |
| Col9a1 enhancer element | Genzer and Bridgewater Nucleic Acids Res. 35(4):1178-86, 2007 |
| Gata2 intronic enhancer | Khandekar et al., Development Mar. 29, 2007 |
| TH promoter enhancer | Gao et al., Brain Res. 1130(1):1-16, 2007 |
| CMV enhancer | InvivoGen cat# pdrive-cag 05A13-SV |
| Woodchuck hepatitis virus posttranscriptional regulatory element | Donello et al., J. Virol. 72(6):5085-92, 1998 |
| Woodchuck hepatitis virus posttranscriptional regulatory element | Schambach et al., Gene Ther. 13(7):641-5, 2006 |
| IRBP | Ying et al., Curr. Eye Res. 17(8):777-82, 1998 |
| CMV enhancer and chicken β-actin promoter | InvivoGen cat# pdrive-cag 05A13-SV |
| CMV enhancer and chicken β-actin promoter and 5'UTR | InvivoGen cat# pdrive-cag 05A13-SV |
| CpG-island | Antoniou et al., Genomics 82:269-279, 2003 |
| Epigenetic elements | Reference |
| Mcp Insulators | Kyrchanova et al., Mol. Cell Biol. 27(8):3035-43, 2007 |
| CpG-island region of the HNRPA2B1 locus | Williams et al., BMC Biotechnol. 5:17, 2005 |
| Chicken b-globin 5'hypersensitive site 4 (cHS4) | Kwaks and Otte 2006 Trends in Biotechnology 24:137-142 |
| Ubiquitous chromatin opening elements (UCOEs) | Kwaks and Otte 2006 Trends in Biotechnology 24:137-142 |
| Matrix associated regions (MARs) | Kwaks and Otte 2006 Trends in Biotechnology 24:137-142 |
| Stabilising and antirepressor elements (STAR) | Kwaks and Otte 2006 Trends in Biotechnology 24:137-142 |
| Human growth hormone gene silencer | Trujillo MA et al. 2006 Mol Endocrinol 20:2559 |

TABLE 5

Exemplary Vectors

Viral Vectors

| Delivery Method | Serotype | Reference |
|---|---|---|
| AAV (ssAAV or scAAV) | All serotypes, including but not limited to 1, 2, 3, 4, 5, 6, 7, 8, 9, 10, 11, 12, | Lebkowski et al., Mol. Cell Biol. 8(10):3988-96, 1988 Flannery et al., Proc. Natl. Acad. Sci. U.S.A. 94(13):6916-21, 1997 |
| Lentivirus (for example but not exclusively Feline-FIV, Equine-EIAV, Bovine-BIV and Simian-SIV). | VSV-G Rabies-G Further serotypes** | Pang et al., Mol. Vis. 12: 756-67, 2006 Takahashi Methods Mol. Biol. 246:439-49, 2004 Balaggan et al., J. Gene Med. 8(3):275-85, 2006 |

TABLE 5-continued

Exemplary Vectors

| | |
|---|---|
| Adenovirus | Bennett et al., Nat. Med. 2(6):649-54, 1996 |
| Simian papovirius SV40 | Kimchi-Sarfaty et al., Hum. Gene Ther. 13(2):299-310, 2002 |
| Semliki Forest Virus | DiCiommo et al., Invest. Ophthalmol. Vis. Sco. 45(9):3320-9, 2004 |
| Sendai Virus | Ikeda et al., Exp. Eye Res. 75(1):39-48, 2002 |

The list provided is not exhaustive; other viral vectors and derivatives, natural or synthesized could be used in the invention.

Non Viral Vectors or Delivery Methods

| Delivery Method | Reference |
|---|---|
| Cationic liposomes | Sakurai et al., Gene Ther. 8(9):677-86, 2001 |
| HVJ liposomes | Hangai et al., Arch. Ophthalmol. 116(3):342-8, 1998 |
| Polyethylenimine | Liao and Yau Biotechniques 42(3):285-6, 2007 |
| DNA nanoparticles | Farjo et al., PloS ONE 1:e38, 2006 |
| Dendrimers | Marano et al., Gene Ther. 12(21):1544-50, 2005 |
| Bacterial | Brown and Giaccia Cancer Res. 58(7):1408-16, 1998 |
| Macrophages | Griffiths et al., Gene Ther. 7(3):255-62, 2000 |
| Stem cells | Hall et al., Exp. Hematol. 34(4):433-42, 2006 |
| Retinal transplant | Ng et al., Chem. Immunol. Allergy 92:300-16, 2007 |
| Marrow/Mesenchymal stromal cells | Kicic et al., J. Neurosci. 23(21):7742-9, 2003 |
| Implant (e.g., Poly(imide)uncoated or coated) | Chng et al., J. Gene Med. 9(1):22-32, 2007 Montezuma et al., Invest. Ophthalmol. Vis. Sci. 47(8):3514-22, 2006 |
| Electroporation | Featherstone A. Biotechnol. Lab. 11(8):16, 1993 |
| Targeting peptides (for example but not exclusively Tat) | Trompeter et al., J. Immunol Methods. 274(1-2):245-56, 2003 |
| Lipid mediated (e.g., DOPE, PEG) | Nagahara et al., Nat. Med. 4(12):1449-52, 1998 Zeng et al., J. Virol. 81(5):2401-17, 2007 Caplen et al., Gene Ther. 2(9):603-13, 1995 Manconi et al., Int. J. Pharm. 234(1-2):237-48, 2006 Amrite et al., Invest. Ophthalmol. Vis. Sci. 47(3):1149-60, 2006 Chalberg et al., Invest. Ophthalmol. Vis. Sci. 46(6):2140-6, 2005 |

TABLE 6

Exemplary neurotrophic factors, anti-apoptotic agents and antioxidants. Neurotrophic factor genes, anti-apoptotic agents or antioxidants which may be used in conjunction with the optimised NdiI therapy contemplated in this patent application. These genes may be delivered at the same time as the NdiI therapy or at a different time, using the same vector as the NdiI therapy or a different one. Neurotrophic factor, anti-apoptotic agents or antioxidants genes may be expressed from ubiquitously expressed promoters such as CMV and Ubiquitin (Table 4) or from one of the promoters described in Tables 2 and 3.

| Neurotrophic factor | Reference |
|---|---|
| NGF | Carmignoto et al., 1989 |
| b-NGF | Lipps 2002 |
| NT-3 | Lu et al., 2011 |
| NT4 | Krishnamoorthy et al., 2001 |
| BDNF | Krishnamoorthy et al., 2001; DiPolo et al., 1998; Garcia and Sharma 1998; Carmignoto et al., 1989 |
| GDNF | Wu et al., 2004, Frasson et al., 1999, Gregory-Evans et al., 2009 |
| NTN (Neurturin) | Koeberle et al 2002 |
| aFGF and bFGF | Faktorovich et al. 1900; LaVail et al., 1991, 1992 Perry et al., 1995; McLaren and Inana 1997; Akimoto et al., 1999; Uteza et al., 1999; Lau et al., 2000 |
| LIF | Joly et al., 2008, Rhee and Yang, 2010 |
| CNTF | Sieving et al., 2006, Thanos et al., 2009, Li et al., 2011 |
| Hepatocyte growth factor | Tönges et al., 2011 |
| PDGF | Akiyaman et al., 2006 |
| VEGF | Trujillo et al., 2007 |
| PEDF | Cayouette et al., 1999 |
| RdCVF | Leveillard et al., 2004 |
| Chondroitinase ABC | Liu 2011 |
| Erythropoietin | Rex et al., 2009, Rong et al., 2011, Gong et al 2011, Hu et al., 2011, Sullivan et al., 2011 |
| Suberythropoietc Epo | Wang et al., 2011 |

| Anti-apoptotic agents | Reference |
|---|---|
| Calpain inhibitor I | McKenan et al., 2007 |
| Calpain inhibitor II | McKenan et al., 2007 |
| Calpeptin | McKenan et al., 2007 |
| PARP | |
| Norgestrel | Doonan et al., 2011 |

| Antioxidant | Reference |
|---|---|
| Vitamin C | www.nei.nih.gov/amd |
| Vitamin E | www.nei.nih.gov/amd |
| Beta-carotene | www.nei.nih.gov/amd |
| SOD2 +/− catalase | Jung et al., 2007, Usui et al., 2009, Doonan al., 2009 |
| Rosiglitazone | Doonan et al., 2009 |
| Sestrin-1 | Budanov et al., 2002, 2004 |
| PPAR | Aoun et al., 2003, Zhao et al., 2006 Tomita et al., 2005, Komeina et al., 2006, 2007 |
| Lutein | Li et al., 2010 |

TABLE 7

Disease phenotypes and genotypes associated with mitochondrial disease.
Clinical Phenotypes (non-LHON) Associated with mtDNA Polypeptide Gene Mutations
(as determined using MITOMAP software available on the world wide web at mitomap.org.bin/view/pl/MITOMAP/ClinicalPhenotypesPolypeptide)

| Syndromes | Locus | Disease* | Allele | Nucleotide Change | AA Change |
|---|---|---|---|---|---|
| Dystonia | MTND1 | Adult-Onset Dystonia | A3796G | A-G | T164A |
| Dystonia, Leigh Syndrome | MTND6 | LS/Dystonia | T14487C | T-C | M63V |
| Dystonia, Leigh Syndrome | MTND6 | LDYT/LS | G14459A | G-A | A72V |

TABLE 7-continued

Disease phenotypes and genotypes associated with mitochondrial disease.
Clinical Phenotypes (non-LHON) Associated with mtDNA Polypeptide Gene Mutations
(as determined using MITOMAP software available on the world wide web at
mitomap.org.bin/view/pl/MITOMAP/ClinicalPhenotypesPolypeptide)

| | | | | | |
|---|---|---|---|---|---|
| Leigh Syndrome | MTND3 | LS | T10158C | T-C | S34P |
| Leigh Syndrome | MTND3 | LS-like/ESOC | T10191C | T-C | S45P |
| Leigh Syndrome | MTND4 | LS | C11777A | C-A | R340S |
| Leigh Syndrome | MTND5 | LS | T12706C | T-C | F124L |
| Leigh syndrome | MTATP6 | LS/FBSN | T9176C | T-C | L217P |
| Leigh Syndrome | MTATP6 | LS | T9176G | T-G | L217R |
| Leigh Syndrome | MTATP6 | LS | T9185C | T-C | L220P |
| Leigh Syndrome | MTATP6 | LS | T9191C | T C | L222P |
| Leigh Syndrome | MTATP6 | LS/NARP | T8993C | T-C | L156P |
| Neurogenic Muscle Weakness Ataxia and Retinitis Pigmentosa | MTATP6 | NARP | T8993G | T-G | L156R |
| Leigh Syndrome | MTCO3 | LS-like | C9537insC | C-CC | Q111frameshift |
| Encephalomyopathy, MELAS | MTND1 | MELAS | T3308C | T C | M1T |
| Encephalomyopathy, MELAS | MTND1 | MELAS/LHON | G3376A | G-A | E24K |
| Encephalomyopathy, MELAS | MTND1 | MELAS | G3697A | G-A | G131S |
| Encephalomyopathy, MELAS | MTND1 | MELAS | G3946A | G-A | E214K |
| Encephalomyopathy, MELAS | MTND1 | MELAS | T3949C | T-C | Y215H |
| Encephalomyopathy, MELAS | MTND4 | MELAS | A11084G | A-G | T109A |
| Encephalomyopathy, MELAS | MTND5 | MELAS | A12770G | A-G | E145G |
| Encephalomyopathy, MELAS | MTND5 | MELAS/LHON/LS overlap syndrome | A13045C | A-C | M237L |
| Encephalomyopathy, MELAS | MTND5 | MELAS/LS | A13084T | A-T | S250C |
| Encephalomyopathy, MELAS | MTND5 | MELAS/LS | G13513A | G-A | D393N |
| Encephalomyopathy, MELAS | MTND5 | MELAS | A13514G | A-G | D393G |
| Encephalomyopathy, MELAS | MTND6 | MELAS | G14453A | G-A | A74V |
| Encephalomyopathy, MELAS | MTCYB | MELAS/PD | 14787del4 | TTAA-del | I14frameshift |
| Epilepsy | MTCO1 | Therapy-resistant Epilepsy | C6489A | C-A | L196I |
| Encephalomyopathy, Multisystem Disorder | MTCO1 | Multisystem Disorder | G6930A | G-A | G343Ter |
| Encephalomyopathy, Multisystem Disorder | MTCOI | Myopathy and Cortical Lesions | 6015del5 | Del 5 bp | Frameshift, 42 peptide |
| Encephalomyopathy | MTCO2 | Encephalomyopathy | T7587C | T-C | M1T |
| Encephalomyopathy, Multisystem Disorder | MTCO2 | Multisystem Disorder | G7896A | G-A | W104Ter |
| Encephalomyopathy, Lactic Acidosis | MTCO2 | Lactic Acidosis | 8042del2 | AT-del | M153Ter |
| Encephalomyopathy | MTCO3 | Encephalomyopathy | G9952A | G-A | W248Ter |
| Encephalomyopathy, MELAS | MTCO3 | MELAS/PEM/NAION | T9957C | T-C | F251L |
| Encephalomyopathy, | MTATP | Lactic Acidosis/ | 9205del2 | TA-del | Ter227M |

TABLE 7-continued

Disease phenotypes and genotypes associated with mitochondrial disease.
Clinical Phenotypes (non-LHON) Associated with mtDNA Polypeptide Gene Mutations
(as determined using MITOMAP software available on the world wide web at
mitomap.org.bin/view/pl/MITOMAP/ClinicalPhenotypesPolypeptide)

| | | | | | |
|---|---|---|---|---|---|
| Lactic Acidosis | 6 | Seizures | | | |
| Encephalomyopathy, Lactic Acidosis | MTCYB | Multisystem Disorder | A15579G | A-G | Y278C |
| Encephalomyopathy, Septo-Optic Dysplasia | MTCYB | Septo-Optic Dysplasia | T14849C | T-C | S35P |
| MM, Exercise Intolerance | MTCYB | EXIT | G14846A | G-A | G34S |
| Mitochondrial Myopathy | MTCYB | MM | G15059A | G-A | G190Ter |
| MM, Exercise Intolerance | MTCYB | EXIT | G15084A | G-A | W113Ter |
| MM, Exercise Intolerance | MTCYB | EXIT | G15150A | G-A | W135Ter |
| MM, Exercise Intolerance | MTCYB | EXIT | G15168A | G-A | W141Ter |
| MM, Exercise Intolerance | MTCYB | EXIT | T15197C | T-C | S151P |
| MM, Exercise Intolerance | MTCYB | EXIT/ Encephalo-myopathy | G15242A | G-A | G166Ter |
| MM, Exercise Intolerance | MTCYB | EXIT | G15497A | G-A | G251S |
| MM, Exercise Intolerance | MTCYB | EXIT | 15498del24 | 24 bp deletion- | 251GDPDNYTL-del258 |
| MM, Exercise Intolerance | MTCYB | EXIT | G15615A | G-A | G290D |
| MM, Exercise Intolerance | MTCYB | EXIT | G15723A | G-A | W326Ter |
| Mitochondrial Myopathy | MTCYB | MM | G15762A | G-A | G339E |
| MM, CPEO | MTND4 | CPEO | T11232C | T-C | L140P |
| MM, Exercise Intolerance | MTND4 | EXIT | G11832A | G-A | W358Ter |
| MM, Exercise Intolerance | MTCO1 | EXIT/ Myoglobinuria | G5920A | G-A | W6Ter |
| Mitochondrial Myopathy | MTCO1 | MM & Rhabdomyolysis | G6708A | G-A | G269Ter |
| Mitochondrial Myopathy | MTCO2 | MM | T7671A | T-A | M29K |
| MM, Exercise Intolerance | MTCO2 | EXIT/ Rhabdomyolysis | T7989C | T-C | L135P |
| Mitochondrial Myopathy | MTCO3 | Myopathy and Myoglobinuria | 9487del15 | Del 15 bp | Removed 5 aa |
| Hypertrophic Cardiomyopathy | MTCYB | HCM | G15243A | G-A | G166E |
| Hypertrophic Cardiomyopathy | MTCYB | HCM | G15498A | G-A | G251D |
| Deafness | MTCO1 | DEAF | A7443G | A-G | Ter514G |
| Deafness | MTCO1 | DEAF | 1A7445C | A-C | Ter514S |
| Deafness-Sensory Neural Hearing Loss | MTCO1 | SNHL/LHON | G7444A | G-A | Ter514K |
| Deafness-Sensory Neural Hearing Loss | MTCO1 | SNHL | A7445G | A-G | Ter514Ter |
| Deafness-Sensory Neural Hearing Loss | MTCO2 | SNHL | A8108G | A-G | I175V |
| Deafness-Sensory Neural Hearing Loss | MTND6 | SNHL | C14340T | C-T | V112M |
| Diabetes Mellitus | MTND1 | NIDDM/PEO | G3316A | G-A | A4T |
| Diabetes Mellitus | MTND4 | DM | A12026G | A-G | I423V |
| Alzheimer & Parkinson Disease | MTND1 | ADPD | A3397G | A-G | M31V |
| Alzheimer & Parkinson Disease | MTND2 | AD | G5460A | G-A | A331T |
| Alzheimer & Parkinson Disease | MTND2 | AD | G5460T | G-T | A331S |

TABLE 7-continued

Disease phenotypes and genotypes associated with mitochondrial disease.
Clinical Phenotypes (non-LHON) Associated with mtDNA Polypeptide Gene Mutations
(as determined using MITOMAP software available on the world wide web at
mitomap.org.bin/view/pl/MITOMAP/ClinicalPhenotypesPolypeptide)

| | | | | | |
|---|---|---|---|---|---|
| Idiopathic Sideroblastic Anemia | MTCO1 | SIDA | T6721C | T-C | M273T |
| Idiopathic Sideroblastic Anemia | MTCO1 | SIDA | T6742C | T-C | I280T |

Abbreviations
♦Plasmy: Ho, homoplasmy; He, heteroplasmy
*Disease: AD, Alzheimer's Disease; ADPD, Alzheimer's Disease and Parkinsons's Disease; CPEO, Chronic Progressive External Ophthalmoplegia; EXIT, exercise intolerance; LHON Leber Hereditary Optic Neuropathy; LS, Leigh Syndrome; MELAS, Mitochondrial Encephalomyopathy, Lactic Acidosis, and Stroke-like episodes; MM, mitochondrial myopathy; NAION Nonarteritic Anterior Ischemic Optic Neuropathy; NARP, Neurogenic muscle weakness, Ataxia, and Retinitis Pigmentosa; NIDDM, Non-Insulin Dependent Diabetes Mellitus; SIDA, sideroblastic anemia; SNHL, Sensorineural Hearing Loss.
** Status: Cfrm, considered confirmed by multiple reports in the literature; Prov, provisional isolated report(s), not yet confirmed by multiple labs; P.M., reported originally in the literature at pathogenic but now generally considered to be a polymorphic variant.
Clinical Phenotypes (non-LHON) Associated with mtDNA, rRNA, & tRNA Mutations (as determined using MITOMAP software available on the world wide web at mitomap.org/bin/view.pl/MITOMAP/ClinicalPhenotypesRNA)

| Syndromes | Locus | Disease* | Allele | RNA |
|---|---|---|---|---|
| Encephalomyopathy, Leigh Syndrome | MTTV | LS | C1624T | tRNA Val |
| Encephalomyopathy, Leigh Syndrome | MTTV | Adult LS | G1644T | tRNA Val |
| Encephalomyopathy Leigh Syndrome | MTTW | MILS | A5537insT | tRNA Trp |
| Encephalomyopathy MERRF | MTTK | MERRF | A8344G | ItRNA Lys |
| Encephalomyopathy MERRF | MTTK | MERRF | T8356C | tRNA Lys |
| Encephalomyopathy MERRF | MTTK | MERRF | G8361A | tRNA Lys |
| Encephalomyopathy MERRF | MTTK | MERRF/MICM+ DEAF/Autism | G8363A | tRNA Lys |
| Encephalomyopathy MERRF | MTTL1 | MERRF/KSS overlap | G3255A | tRNA Leu (UUR) |
| Encephalomyopathy MERRF | MTTF | MERRF | G611A | tRNA Phe |
| Encephalomyopathy Myoclonus and Psychomotor Regression | MTTD | MEPR | A7543G | tRNA Asp |
| Encephalomyopathy Ataxia, Myoclonus and Deafness | MTTV | AMDF | G1606A | tRNA Val |
| Encephalomyopathy MERRF | MTTH | MERRF-MELAS/ Cerebral edema | G12147A | tRNA His |
| Encephalomyopathy MELAS | MTTL1 | MELAS | A3243G | tRNA Leu (UUR) |
| Encephalomyopathy MELAS | MTTL1 | MELAS | G3244A | tRNA Leu (UUR) |
| Encephalomyopathy MELAS | MTTL1 | MELAS | A3252G | tRNA Leu (UUR) |
| Encephalomyopathy MELAS | MTTL1 | MELAS | C3256T | tRNA Leu (UUR) |
| Encephalomyopathy MELAS | MTTL1 | MELAS/Myopathy | T3258C | tRNA Leu (UUR) |
| Encephalomyopathy MELAS | MTTL1 | MELAS | T3271C | tRNA Leu (UUR) |
| Encephalomyopathy MELAS | MTTL1 | MELAS | T3291C | tRNA Leu (UUR) |
| Encephalomyopathy MELAS | MTTV | MELAS | G1642A | tRNA Val |
| Encephalomyopathy MELAS | MTTQ | MELAS/ Encephalopathy | G4332A | tRNA Gln |
| Encephalomyopathy MELAS | MTTF | MELAS | G583A | tRNA Phe |
| Encephalomyopathy MELAS | MTRNR2 | MELAS | C3093G | 16S rRNA |

TABLE 7-continued

Disease phenotypes and genotypes associated with mitochondrial disease.
Clinical Phenotypes (non-LHON) Associated with mtDNA Polypeptide Gene Mutations
(as determined using MITOMAP software available on the world wide web at
mitomap.org.bin/view/pl/MITOMAP/ClinicalPhenotypesPolypeptide)

| | | | | |
|---|---|---|---|---|
| Encephalomyopathy | MTTL1 | PEM | T3271delT | tRNA Leu (UUR) |
| Encephalomyopathy | MTTI | Progressive Encephalopathy | T4290C | tRNA Ile |
| Encephalomyopathy | MTTI | (Mitochondria Encephalo-cardiomyopathy | C4320T | tRNA Ile |
| Encephalomyopathy | MTTW | Encephalomyopathy | G5540A | tRNA Trp |
| Encephalomyopathy | MTTC | Encephalopathy | T5814C | tRNA Cys |
| Encephalomyopathy | MTTS1 | PEM/AMDF | C7472insC | tRNA Ser (UCN) |
| Encephalomyopathy | MTTS1 | PEM/MERME | T7512C | tRNA Ser (UCN) |
| Encephalomyopathy | MTTK | Encephalopathy | C8302T | tRNA Lys |
| Encephalomyopathy | MTTK | Mitochondrial Encephalopathy | G8328A | tRNA Lys |
| Encephalomyopathy | MTTG | PEM | T10010C | tRNA Gly |
| Encephalomyopathy | MTATT | Encephalomyopathy | G15915A | tRNA Thr |
| Encepehaolmyopathy Rett Syndrome | MTRNR2 | Rett Syndrome | C2835T | rRNA 16S |
| Multisystem Disease | MTTI | Varied familial presentation | G4284A | tRNA Ile |
| Encephalomyopathy Gastrointestinal Reflux and Sudden Infant Death Syndrome | MTTG | GER/SIDS | A10044G | tRNA Gly |
| Mitochondrial Myopathy | MTTF | MM | T582C | tRNA Phe |
| Mitochondrial Myopathy | MTTF | MM | T618C | tRNA Phe |
| Mitochondrial Myopathy | MTTL1 | MM | G3242A | tRNA Leu (UUR) |
| Mitochondrial Myopathy | MTTL1 | MM/CPEO | A3243G | TRNA Leu(UUR) |
| Mitochondrial Myopathy | MTTL1 | MM | A3243T | tRNA Leu(UUR) |
| Mitochondrial Myopathy | MTTL1 | MM/CPEO | T3250C | tRNA Leu (UUR) |
| Mitochondrial Myopathy | MTTL1 | MM | A3251G | tRNA Leu (UUR) |
| Mitochondrial Myopathy | MTTL1 | MM | C3254G | tRNA Leu (UUR) |
| Mitochondrial Myopathy | MTTL1 | Myopathy | A3280G | tRNA Leu (UUR) |
| Mitochondrial Myopathy | MTTL1 | Myopathy | A3288G | TRNA Leu(UUR) |
| Mitochondrial Myopathy | MTTL1 | MM | A3302G | tRNA Leu (UUR) |
| Mitochondrial Myopathy | MTTI | MM | A4267G | tRNA Ile |
| Mitochondrial Myopathy | MTTQ | Myopathy | T4370AT | tRNA Gln |
| Mitochondrial Myopathy | MTTM | MM | T4409C | tRNA Met |
| Mitochondrial Myopathy | MTTM | MM | G4450A | tRNA Met |
| Mitochondrial Myopathy | MTTW | MM | G5521A | tRNA Trp |
| Mitochondrial Myopathy | MTTS1 | MM | T7480G | tRNA Ser (UCN) |
| Mitochondrial Myopathy | MTTS1 | MM | G7497A | tRNA Ser (UCN) |
| Mitochondrial Myopathy | MTTK | Myopathy | T8355C | tRNA Lys |
| Mitochondrial Myopathy | MTTK | Myopathy | T8362G | tRNA Lys |
| Mitochondrial Myopathy | MTTG | Myopathy | G10014A | tRNA Gly |
| Mitochondrial Myopathy | MTTL2 | MM | A12320G | tRNA Leu (CUN) |
| Mitochondrial Myopathy | MTTE | MM + DM | T14709C | tRNA Glu |
| Mitochondrial Myopathy | MTTT | MM | T15940delT | tRNA Thr |

TABLE 7-continued

Disease phenotypes and genotypes associated with mitochondrial disease.
Clinical Phenotypes (non-LHON) Associated with mtDNA Polypeptide Gene Mutations
(as determined using MITOMAP software available on the world wide web at
mitomap.org.bin/view/pl/MITOMAP/ClinicalPhenotypesPolypeptide)

| | | | | |
|---|---|---|---|---|
| Mitochondrial Myopathy | MTTP | MM | C15990T | tRNA Pro |
| Mitochondrial Myopathy, Exercise Intolerance | MTTY | Exercise Intolerance | T5874G | tRNA Tyr |
| Mitochondrial Myopathy, CPEO | MTTL1 | CPEO | C3254T | tRNA Leu (UUR) |
| Mitochondrial Myopathy, CPEO | MTTI | CPEO | T4274C | tRNA Ile |
| Mitochondrial Myopathy, CPEO | MTTI | CPEO | T4285C | tRNA Ile |
| Mitochondrial Myopathy, CPEO | MTTI | CPEO/MS | G4298A | tRNA Ile |
| Mitochondrial Myopathy, CPEO | MTTI | CPEO | G4309A | tRNA Ile |
| Mitochondrial Myopathy, CPEO | MTTA | CPEO | T5628C | tRNA Ala |
| Mitochondrial Myopathy, CPEO | MTTN | CPEO/MM | T5692C | tRNA Asn |
| Mitochondrial Myopathy, CPEO | MTTN | CPEO/MM | G5698A | tRNA Asn |
| Mitochondrial Myopathy, CPEO | MTTN | CPEO/MM | G5703G | tRNA Asn |
| Mitochondrial Myopathy, CPEO | MTTK | CPEO + Myoclonus | G8342A | tRNA Lys |
| Mitochondrial Myopathy, CPEO | MTTL2 | CPEO | G12294A | tRNA Leu (CUN) |
| Mitochondrial Myopathy, CPEO | MTTL2 | CPEO/Stroke/CM | A12308G | tRNA Leu (CUN) |
| Mitochondrial Myopathy, CPEO | MTTL2 | CPEO | T12311C | tRNA Leu (CUN) |
| Mitochondrial Myopathy, CPEO | MTTL2 | CPEO | G12315A | tRNA Leu (CUN) |
| Mitochondrial Myopathy, Ocular Myopathy | MTTL1 | Ocular myopathy | T3273C | tRNA Leu (UUR) |
| Mitochondrial Myopathy, KSS | MTTL1 | KSS | G3249A | tRNA Leu (UUR) |
| Mitochondrial Myopathy Cytopathy | MTTY | Mitochondrial Cytopathy/ FSGS | A5843G | tRNA Tyr |
| Mitochondrial Myopathy Cytopathy | MTTK | Mitochondrial cytopathy | A8326G | tRNA Lys |
| Mitochondrial Myopathy Cytopathy | MTTP | Mitochondrial cytopathy | G15995A | tRNA Pro |
| Mitochondrial Myopathy with Myoglobinuria | MTTF | Myoglobinuria | A606G | TRNA Phe |
| Mitochondrial Myopathy, Gastrointestinal Syndrome | MTTW | Gastrointestinal Syndrome | G5532A | tRNA Trp |
| Mitochondrial Myopathy, Mitochondrial Neurogastrointestinal Encephalomyopathy | MTTK | MNGIE | G8313A | tRNA Lys |
| Mitochondrial Myopathy with Chronic Intestinal Pseudoobstruction | MTTG | CIPO | A10006G | tRNA Gly |
| Mitochondrial Myopathy with Chronic Intestinal Pseudoobstruction | MTTS1 | CIPO | C12246G | tRNA Ser (AGY) |
| Mitochondrial Myopathy with Renal Dysfunction | MTTF | Tubulointerstitial nephritis | A608G | tRNA Phe |
| Mitochondrial Myopathy Lethal Infantile Mitochondrial Myopathy | MTTT | LIMM | A15923G | tRNA Thr |

TABLE 7-continued

Disease phenotypes and genotypes associated with mitochondrial disease.
Clinical Phenotypes (non-LHON) Associated with mtDNA Polypeptide Gene Mutations
(as determined using MITOMAP software available on the world wide web at
mitomap.org.bin/view/pl/MITOMAP/ClinicalPhenotypesPolypeptide)

| | | | | |
|---|---|---|---|---|
| Mitochondrial Myopathy Lethal Infantile Mitochondrial Myopathy | MTTT | LIMM | A15924G | tRNA Thr |
| Mitochondrial Myopathy and cardiomyopathy | MTTL1 | MMC | A3260G | tRNA Leu (UUR) |
| Mitochondrial Myopathy and cardiomyopathy | MTTL1 | MMC | C3303T | tRNA Leu (UUR) |
| Maternaly Inherited Hypertrophic Cardiomyopathy | MTTI | MHCM | A4295G | tRNA Ile |
| Maternally Inherited Cardiomyopathy | MTTI | MICM | A4300G | tRNA Ile |
| Cardiomyopathy | MTTK | Cardiomyopathy | A8348G | tRNA Lys |
| Maternally Inherited Hypertrophic Cardiomyopathy | MTTG | MHCM | T9997C | tRNA Gly |
| Maternally Inherited Cardiomyopathy | MTTH | MICM | G12192A | tRNA His |
| Cardiomyopathy | MTTL2 | Dilated Cardiomyopathy | T12297C | tRNA Leu (CUN) |
| Fatal Infantile Cardiomyopathy Plus (MELAS) | MTTI | FICP | A4269G | tRNA Ile |
| Fatal Infantile Cardiomyopathy Plus (MELAS) | MTTI | FICP | A4317G | tRNA Ile |
| Deafness | MTRNR1 | DEAF | A827G | 12S rRNA |
| Deafness | MTRNR1 | DEAF | T961C | 12S rRNA |
| Deafness | MTRNR1 | DEAF | T961delT+C(n)ins | 12S rRNA |
| Deafness | MTRNR1 | DEAF | T961insC | 12S rRNA |
| Deafness | MTRNR1 | DEAF | T1005C | 12S rRNA |
| Deafness Sensory Neural Hearing Loss | MTRNR1 | SNHL | T1095C | 12S rRNA |
| Deafness | MTRNR1 | DEAF | A1116G | 12S rRNA |
| Deafness | MTRNR1 | DEAF | C1494T | 12S rRNA |
| Deafness | MTRNR1 | DEAF | A1555G | 12S rRNA |
| Deafness Sensory Neural Hearing Loss | MTTS1 | SNHL | T7510C | tRNA Ser (UCN) |
| Deafness Sensory Neural Hearing Loss | MTTS1 | SNHL | T7511C | tRNA Ser(UCN) |
| Deafness cerebellar dysfunction | MTTS1 | Deafness and Cerebellar Dysfunction | 7472insC | tRNA Ser(UCN) |
| Deafness | MTTH | DEAF + RP | G12183A | tRNA His |
| Deafness Ataxia and MR | MTTE | Deafness, Mental Retaration, Cerebellar Dysfunction | 14709G | tRNA Glu |
| Diabetes Mellitus | MTRNR1 | DM | C1310T | 12S |
| Diabetes Mellitus | MTRNR1 | DM | A1438G | 12S |
| Diabetes Mellitus & Deafness | MTTL1 | DM/DMDF | A3243G | tRNA Leu (UUR) |
| Diabetes Mellitus | MTTL1 | DM | T3264C | tRNALeu (UUR) |
| Diabetes Mellitus | MTTL1 | DM | T3271C | tRNA Leu (UUR) |
| Diabetes Mellitus Metabolic Syndrome | MTTI | Metabolic Syndrome & Hypomagnesemia | T4291C | tRNA Ile |

TABLE 7-continued

Disease phenotypes and genotypes associated with mitochondrial disease.
Clinical Phenotypes (non-LHON) Associated with mtDNA Polypeptide Gene Mutations
(as determined using MITOMAP software available on the world wide web at
mitomap.org.bin/view/pl/MITOMAP/ClinicalPhenotypesPolypeptide)

| | | | | |
|---|---|---|---|---|
| Diabetes Mellitus & Deafness & Cardiomyopathy | MTTK | DMDF/MERRF/HCM | A8296G | tRNA Lys |
| Diabetes Mellitus & Deafness and Retinitis Pigmentosa | MTTS2 | DMDF | C12258A | tRNA Ser (AGY) |
| Movement Disorder | MTTV | Movement Disorder | T1659C | tRNA Val |
| Alzheimer & Parkinson Disease | MTRNR2 | ADPD | G3196A | rRNA 16S |
| Alzheimer & Parkinson Disease Deafness & Migraine | MTTQ | ADPD/Hearing loss and migraine | T4336C | tRNA Gln |
| Dementia and Chorea | MTTW | DEMCHO | G5549A | tRNA Trp |

Abbreviations
Plasmy: Ho, homoplasmy; He, heteroplasmy
*Disease: AD, Alzheimer's Disease; ADPD, Alzheimer's Disease and Parkinsons's Disease; CIPO Chronic Intestinal Pseudoobstruction with myopathy and Ophthalmoplegia; CPEO, Chronic Progressive External Ophthalmoplegia; DEMCHO, Dementia and Chorea; DM, Diabetes Mellitus; DMDF Diabetes Mellitus & Deafness; EXIT, exercise intolerance; FBSN Familial Bilateral Striatal Necrosis; FICP Fatal Infantile Cardiomyopathy Plus, a MELAS-associated cardiomyopathy; HCM, Hypertrophic CardioMyopathy; LS, Leigh Syndrome; MELAS, Mitochondrial Encephalomyopathy, Lactic Acidosis, and Stroke-like episodes; MERRF Myoclonic Epilepsy and Ragged Red Muscle Fibers; MHCM Maternally Inherited Hypertrophic Cardiomyopathy; MICM Maternally Inherited Cardiomyopathy; MM, mitochondrial myopathy; NAION Nonarteritic Anterior Ischemic Optic Neuropathy; NARP, Neurogenic muscle weakness, Ataxia, and Retinitis Pigmentosa; NIDDM, Non-Insulin Dependent Diabetes Mellitus; SNHL, Sensorineural Hearing Loss.
**Status: Cfrm, considered confirmed by multiple reports in the literature; Prov, provisional isolated report(s), not yet confirmed by multiple labs; P.M., reported originally in the literature at pathogenic but now generally considered to be a polymorphic variant.

TABLE 8

Disease phenotypes which are associated with mitochondrial mutations and where similar phenotypes may be caused by genomic mutations. Patients with these phenotypes, whether due to mitochondrial or genomic mutations, may benefit from OphNDI1 treatment. Possible target tissues for therapies directed to these disorders are indicated.

| Disease phenotype | Possible target tissue type |
|---|---|
| Encephalomyopathy | Brain, Muscle |
| Cardiomyopathy | Muscle |
| Myopathy | Muscle |
| Migraine | Brain |
| Gastrointestinal Reflux and Sudden Infant Death Syndrome | Brain |
| Lactic Acidosis | Muscle |
| Muscle Weakness | Muscle |
| Deafness | Neurons |
| Alzheimer | Brain |
| Dementia | Brain |
| Epilepsy | Brain |
| Septo-Optic Dysplasia | Brain, Optic Nerve, Pituitary |
| Parkinson Disease | Brain |
| Anemia | Bone marrow |
| Dystonia | Brain |
| Ataxia | Brain |
| Sensory Neural Hearing Loss | Neurons in ear |
| Chorea | Brain |
| Retinitis Pigmentosa | Photoreceptor cell in retina |
| Exercise Intolerance | Muscles |
| Diabetes | Pancreas |
| Age related macular degeneration | Photoreceptor cell in retina |

SEQUENCE LISTING (1009 sequences)

SEQ ID NO: 1 - DNA, 1542 bp, Saccharomyces cerevisiae
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 2 - DNA, 1542 bp, Artificial Sequence
  source: /note="Description of Artificial Sequence: Synthetic polynucleotide"
atgctgtcgaagaatctgtacagcaacaagcggttgctcacctcgacgaacaccctagtccgcttcgcctccaccagatccacaggggtggaaaactccggggcaggtcctacatcttttaagaccatgaaggtcattgacccccagcacagcgacaagccaaacgtgctgatactgggctcggggtggggagccatttcgtttctgaagcacattgacaccaagaagtacaacgtttccatcatctctcccagaagctatttcttattcacccctttgctgccctctgccccagttgggaccgtagacgaaaagtcaattattgagcccatcgttaactttgctctgaagaaaaaggggaacgtcacctactatgaggcagaagccaccagcatcaaccccgaccggaataccgtgaccataaaatcactgtctgccgtgagccagctataccagcctgaaaaccatctagggctgcatcaagccgaacccgctgagattaagtacgattatttaatcagtgctgtgggtgcggaacctaacacatttggtatccctggggtcactgactacggccatttcctgaaggagatccccaactctttggaaatccggagaacttttgccgccaatctagagaaggctaacttactgccaaagggtgatcccgagagaagaagactactgagcatcgtcgtggttggcggtggccctactggtgtagaggctgctggtgagctacaggattacgttcaccaggacctgagaaagtttctgcctgcattggccgaagaagtgcagattcacttggtcgaagccctgcccatcgtgttgaatatgttcgagaagaagctttcatcatacgcgcaatcacatttagaaaacacttcgatcaaagtacatctgagaacggctgtggccaaagttgaagaaaagcagttgttggcaaagaccaaacacgaagacggtaaaataaccgaggaaaccatcccatacggtaccttgatttgggccacgggcaacaaggcaagacccgtaatcaccgaccttttcaagaaaattcctgagcaaaactcgtccaagagaggattggccgtgaatgacttcttgcaggtgaaaggcagcaacaacattttcgccatcggtgacaacgcatttgctgggctgcctccaacagcccaagtggcgcaccaggaggccgagtatttggccaagaattttgataagatggcccaaataccaaatttccaaaagaacctatcttcaagaaaggataaaatcgatctcctgttcgaggagaacaactttaaacccttcaaatacaacgacttaggcgccttagcatacctgggaagcgaaagagccattgcaaccatacgttccggtaagagaaccttctacaccggtggtggcctgatgaccttctacttatggagaatcttgtacttgtccatgatcctatctgcaagatcgagattaaaggtgtttttcgactggattaagttagcatttttcaagagggactttttcaaaggattatga

SEQ ID NO: 3 - DNA, 1542 bp, Artificial Sequence
  source: /note="Description of Artificial Sequence: Synthetic polynucleotide"
atgctatcgaagaacttgtatagtaacaagaggttgctcacctcgacgaatacgctagtcagattcgccagcaccagatccacaggcgtcgaaaactccggggctggtcctacatcttttaagaccatgaaagtcattgaccctcagcacagcgacaaacccaacgtgctgatactgggttcgggctggggcgctatctcgtttctgaagcacattgacaccaagaagtacaacgtttccatcatctctcccagaagctacttcttattcacgcctttgctgcccagcgcaccagttgggacagtagacgaaaagtcaattatcgagcccatcgttaacttcgctctcaagaaaaaggggaacgtcacctactatgaggcagaagccacctctatcaatcccgaccggaataccgttaccatcaaatcattatctgccgtgagccagctgtaccaacccgagaaccatctggggctgcatcaagcagaacccgctgagattaagtacgattacttaatcagtgctgtgggcgcggaacccaacacatttggtattcctggggtcaccgattacggtcatttcctgaaggagattcccaactctttggaaataagaagaacttttgccgccaatctggagaaggccaacttactgcctaagggtgatcccgaacggagaagactgctgagcatcgtcgtcgttggtggtggccctactggtgtagaggccgctggcgagctacaggactatgttcaccaggacctgagaaagtttctccctgccttggccgaagaagtccagattcacctggtcgaagctctgcccatcgtgttgaatatgtttgagaagaagctttcatcatacgcgcagtcacatttagaaaacacctcgatcaaagtacatctgagaacggccgtggccaaggttgaagagaagcaattgttggccaagaccaaacacgaggacggcaaaataaccgaagaaactatcccatacggtaccctgatttgggccacgggtaacaaggcaagaccggtaatcaccgaccttttcaagaagatccctgagcaaaacagcagcaagagaggcttggcagtgaacgacttcttgcaggtgaaaggcagcaacaacattttcgccattggtgacaatgcctttgctgggttgccaccaaccgcccaagtagcccaccaagaagccgaatatttggccaagaattttgacaaaatggctcagatcccaaatttccaaaagaatctatcttccagaaaggataaaatcgatctcttgttcgaggaaaacaactttaagcccttcaaatacaacgatttaggtgccctggcctacctgggatccgaaagggccattgcaaccatccgttccggtaagcggacattctacaccggtggtggcttaatgaccttctacttatggagaattctgtacttgtccatgattctatctgccagatcgagattaaaggtgtttttcgactggatcaaactggcattcttcaagagagacttttttaagggactgtag

SEQ ID NO: 4 - DNA, 1542 bp, Artificial Sequence
  source: /note="Description of Artificial Sequence: Synthetic polynucleotide"
atgctgtcgaagaacctgtatagcaacaagaggttgctcacctcgacgaatacgctcgtgcgcttcgcttccaccagatccacaggggtggaaaactccggagctggtcctacatcttttaagaccatgaaagtcattgaccctcagcacagcgacaagccaaacgtgctgatcctgggctctgggtggggagccatctcgtttttaaagcacattgacaccaagaagtacaacgtctccatcatctctcctagaagctatttcttatttacgcctctgttacctagcgcccctgttggaaccgtagacgaaaagtcaatcatcgagcccatcgttaactttgctctcaagaaaaagggcaacgttacctactatgaggcagaagccacctctatcaaccccgacaggaataccgttaccataaaaagcttaagcgccgtgtcccagctataccaacctgagaaccatctagggctgcaccaagccgagcctgctgagattaagtacgattacttaatcagtgctgtaggcgcggagcccaacacctttggtattcctggggtcactgactacggccatttcctgaaggaaattcccaactctctggaaataagaagaacctttgccgccaatctggaaaaggctaacttattgccaaagggtgatcccgaaagaagaagactactgtccattgtggtggttggcggtgggcctacaggtgtagaggccgctggcgaactacaggattatgttcaccaggacctgcggaagttcctccctgcactggccgaggaagtgcaaattcacttggtggaagccctgcccatcgttttgaacatgtttgagaaaaagctgtcatcatacgcgcaaagccatctggaaaacacctcgatcaaagtgcatctgagaaccgctgtcgccaaagtggaagagaagcaattgttggccaagaccaaacacgaagacggtaagataaccgaagaaactattccatacggtaccttgatttgggccaccggcaacaaggcaagaccggtaatcactgaccttttcaagaaaattcctgagcagaacagctccaagcggggattggcagtgaatgactttttgcaggtcaaaggcagcaacaacattttcgccattggtgacaatgcctttgctgggttgccaccaaccgcccaagtggcgcaccaggaggccgaatacttggccaagaattttgataaaatggctcagatcccaaatttccaaaagaacctatcctccagaaaggataagatcgatctcctgttcgaggaaaacaacttcaaacctttcaagtacaacgatttaggtgccttagcatacctgggatccgaaagggccattgcaaccatacgttccggcaagcggaccttttacaccggtggtggcctgatgaccttctacttatggagaattttgtacttgtccatgattctatctgcaagatcgagattaaaggtgtttttcgactggatcaaattagcatttttcaagagagacttcttcaaaggattatga

SEQ ID NO: 5 - DNA, 1542 bp, Artificial Sequence
  source: /note="Description of Artificial Sequence: Synthetic polynucleotide"
atgctgagcaagaacttgtatagcaacaagaggttgctgaccagcaccaacaccctcgtccgcttcgctagcaccagatccacaggggtggaaaactccggagcaggccctacatcttttaagaccatgaaagtcatcgaccctcagcacagcgacaagcccaacgtgctgatactgggctctgggtggggagctatcagctttttaaagcacattgacaccaagaagtacaacgtttccatcatctctcccagaagctatttcttattcacgcctttgctgccttctgcaccagttggaaccgtggacgagaagtcaatcatcgagcccatcgttaattttgctctcaagaaaaaggggaacgttacctactacgaggcagaagccaccagcatcaaccccgacaggaataccgttaccataaaatcattatctgccgtttcccagctataccaacctgaaaaccatctaggcctgcatcaagcagagcctgccgagattaagtacgattacttaatcagtgccgtgggtgcggaacctaacacctttggtatccctggggtcactgattacggccatttcctgaaagaaattcccaacagcttggaaatccggagaacttttgccgccaatctagaaaaggccaacctgttgccaaagggtgatcccgaacggagaagactactgtccatcgtcgtcgttggcggtgggcctacaggcgtagaagccgctggcgaactacaggattacgttcaccaggacctgagaaagtttctgcctgccctggccgaagaagtccaaattcacttggtcgaagccctgcccatcgtgctgaatatgtttgagaaaaagctttcatcatacgcccaaagccatttagaaaacacctcgatcaaagtacatctgagaacggctgtcgccaaagttgaagagaagcaactgttggcaaagaccaaacacgaagacggtaaaataaccgaagaaactattccatacggcactttgatttgggccacgggcaacaaggcaagaccggtgatcactgaccttttcaagaagatccctgagcaaaacagctccaagagaggcttggcagtgaacgactttttgcaggtgaaaggcagcaacaacattttcgccatcggtgacaacgcatttgccggcttgccacctacagcccaagtggcgcaccaagaggccgaatatttggccaagaattttgataagatggcccagataccaaatttccagaagaacctatcttcaagaaaggataaaattgatctcttgttcgaggagaacaactttaaacccttcaaatacaacgatttaggtgccttagcctacctgggatccgaaagagccattgcaaccatacgttccggcaagagaacattctacaccggtggtggcttaatgaccttctacctgtggagaatcttgtacttgagcatgattctatctgcaagatcgagattaaaggtcttcttcgactggattaaattagcattcttcaaaagagacttttttaaaggattatag

SEQ ID NO: 6 - DNA, 1542 bp, Artificial Sequence
  source: /note="Description of Artificial Sequence: Synthetic polynucleotide"
atgctatcgaagaatctgtatagtaacaagcggctgctgacctcgacgaatacgctcgtcagattcgcttccaccagatccaccggcgtggaaaactccggagctggtcctacatctttcaagaccatgaaagtcattgacccccagcacagcgacaaaccaaacgtgctgatactgggttcgggctggggagctatctcgtttttaaagcacattgacaccaagaagtacaacgtttccatcatcagccctagaagctacttcttattcacgcctctgttacctagcgccccagttgggaccgtagacgaaaagtccattattgagcccatcgtgaattttgctctcaagaaaaagggcaacgttacctactatgaggcagaagccacctctatcaaccccgaccggaataccgtgaccataaaatcattaagcgccgttagccagctataccaacctgaaaaccatctgggcctgcaccaagccgaacctgctgaaattaagtacgattatttaatcagtgctgtaggtgccgaacctaacacatttggtatccccggcgtcactgactacggtcatttcctgaaggaaattcccaacagcttggaaatccggagaacttttgccgccaatctagaaaaggctaacttattgccaaagggtgatcccgaaagaagaagactgctgagcattgtcgtggttggcggaggccccacaggtgtagaggccgctggcgaactgcaggactatgtgcaccaggacctgagaaagtttctccctgccctggccgaagaagtgcaaattcacttggtcgaagctctgcccatcgttctgaatatgttcgagaaaaagctttcatcatacgcccagagccatttagaaaacacttcgatcaaagtgcacctgagaaccgccgtcgccaaagttgaagagaagcaattgttggcaaagaccaagcacgaagacggtaaaataaccgaagaaactattccatacggtactctgatttgggccaccggcaacaaggccagacccgtaatcactgacctgttcaagaaaatccccgagcaaaactcgagcaagagaggattggccgtgaacgactttttgcaggtcaaaggcagcaacaacattttcgccattggcgacaatgcctttgccgggttgcctcctacagcccaagtagcgcaccaagaggccgaatacttggccaagaattttgataaaatggcccaaatacccaatttccaaaagaacctatcttccagaaaggataaaatcgacctgttgttcgaggaaaacaacttcaaacctttcaagtacaacgacttaggtgccttagcatacctgggatccgaaagggccattgcaaccatacgttccggtaagagaacattctacaccggtggtggcttaatgaccttctacttatggagaattttgtacttgtccatgattctatctgcaagatcgagactgaaggtctttttcgactggatcaaactggcatttttcaagagagactttttcaaaggattatag

SEQ ID NO: 7 - DNA, 1542 bp, Artificial Sequence
  source: /note="Description of Artificial Sequence: Synthetic polynucleotide"
atgctatcgaagaatttgtatagtaacaagcggttgctcaccagcacgaataccctcgtcagattcgctagcaccagatccacaggggtggaaaactccggggctggtcctacaagctttaagaccatgaaagtcatcgacccccagcacagcgacaaacccaacgtgctgatcctgggttcggggtggggcgccatttcgtttttaaagcacattgacaccaagaagtacaacgtttccatcatctctcctagaagctatttcttatttacgcctttgttacctagcgcaccagttgggacagtggacgaaaagtcaatcatcgagcccatcgttaattttgctctcaagaaaaagggcaacgttacctactatgaggcagaagccacctctatcaatcccgaccggaataccgttaccataaagtcattaagcgccgttagccagctataccaacccgagaaccacctagggctgcatcaagcagaacccgctgagattaagtacgattatttaatcagtgctgtaggtgcggaacctaacacatttggaattcctggggtgactgattacggtcacttcctgaaggagatccccaactctttggaaataagaagaactttcgccgccaatctggagaaggctaacctgttgccaaagggtgatcccgaaagaagaagactgctgagcattgtcgtggtgggtggtgggcccacaggtgtggaggctgctggtgaactacaggattacgttcaccaggacctgagaaagtttctccctgcactggccgaagaagtccagattcacttggtcgaagccctgcccatcgttctgaatatgtttgagaagaagcttagcagctacgcccagagccatctggaaaacacttcgatcaaagtgcatctgagaacggctgtcgccaaggttgaagaaaagcagttgttggcaaagaccaaacacgaagacggtaaaattaccgaggaaactatcccatacggcactctgatttgggccacgggtaacaaggcaagaccggtaatcaccgacctgttcaagaagattcccgagcaaaactcgtccaagagaggattggcagtgaacgactttctgcaggtcaaaggcagcaacaacatcttcgccattggtgacaatgcctttgccggcctgcctccaaccgcccaagtagcgcaccaagaggccgaatatttggccaagaatttcgacaagatggctcagatcccaaatttccaaaagaatctatcctcaagaaaggataaaatcgatctcttgttcgaggagaacaactttaaacctttcaaatacaacgacttaggtgccttagcctacctgggaagcgaaagggccattgccaccataagaagcggcaagagaacattctacaccggtggtggcctgatgaccttctacctgtggcggattctgtacctgtccatgattctatctgcaagatcgagattaaaggtctttttcgactggatcaaactggcctttttcaaaagagacttttttaaaggcttatga

SEQ ID NO: 8 - DNA, 1542 bp, Artificial Sequence
  source: /note="Description of Artificial Sequence: Synthetic polynucleotide"
atgctatcgaagaatttgtacagtaacaagaggttgctgacctcgaccaacacgctcgtcagattcgcttccaccagatccacaggggtggaaaactccggagctggtcccacatctttcaagaccatgaaagtcattgaccctcagcacagcgacaaaccaaacgtgctgatactgggctcggggtggggagctattagctttttaaagcacattgacaccaagaagtacaacgtcagcatcatcagccctagaagctatttcttatttacccccttgttacctagcgcaccagttgggacagtggacgaaaagtcaattattgagcccatcgttaactttgctctgaagaaaaaggggaacgttacctactatgaggcagaagccacctctatcaatcccgacaggaacaccgttaccatcaaatcactgtctgccgttagccagctataccaacctgaaaaccacctagggctgcaccaagcagaacctgccgaaattaagtacgattacttaatcagtgctgtgggtgcggaacctaacacatttggtattcctggggtcaccgattacggccatttcctgaaggaaattcccaacagcttggaaataagaagaactttcgccgccaatctagagaaggctaacctgctgccaaagggcgatcccgagcggagaagactactgtccattgtggtggttggtggagggcctactggtgtggaggccgctggcgaactacaggactatgttcaccaggacctgcggaagtttctccccgccctggccgaggaagtccaaattcacttggtcgaagccctgcccatcgttttgaatatgtttgagaagaagctttcaagctacgcgcagtcacatttagaaaacacttcgatcaaggtacacctgagaaccgccgtcgccaaggttgaagaaaagcaattgttggcaaagaccaaacacgaagacggtaagataaccgaagaaactattccctacggtactttgatttgggccaccggcaacaaggcaagaccggtaatcactgaccttttcaagaaaatccctgagcagaactcgtccaagagaggcttggcagtgaacgactttttgcaggtgaaaggcagcaacaacatcttcgccattggtgacaacgcatttgccgggttgccaccaacagcccaagtagcgcaccaagaggccgaatatctggccaagaattttgataagatggcccaaatccccaatttccaaaagaacctgtcctcacggaaggataaaatcgatctcttgttcgaggagaacaacttcaagcccttcaaatacaacgacttaggtgccctggcctacctgggctccgaaagggccattgcaaccatcagaagcggtaagcggacattttacaccggtggtggcctgatgaccttctacttatggagaatcttgtacctgtccatgatcctatctgcacgcagcagactgaaggtctttttcgactggatcaaattagcatttttcaaaagggacttctttaagggattatga

SEQ ID NO: 9 - DNA, 1542 bp, Artificial Sequence
  source: /note="Description of Artificial Sequence: Synthetic polynucleotide"
atgctatcgaagaacttgtatagcaacaagaggttgctcacctcgacgaatacgctcgtcagattcgcctccaccagatccaccggggtcgaaaactccggggcaggtcccacctcttttaagaccatgaaagtcattgaccctcagcacagcgacaaaccaaacgtgctgatactgggttctgggtggggagctatttcgtttctgaagcacattgacaccaagaagtacaacgtctccatcatctctcctagaagctatttcttattcacgcctttgttaccttctgcaccagtgggaacagtggacgaaaagtcaatcatcgagcccatcgtgaatttcgctctgaagaaaaaggggaacgtcacctactatgaggcagaagccaccagcatcaatcccgaccggaataccgttaccatcaaatcattatctgccgttagccagctgtaccaacctgaaaaccatctagggctgcaccaagcagagcccgccgaaattaagtacgattacttaatcagcgctgtaggtgcggaacctaacacatttggaatccctggcgtgactgattacggtcatttcctgaaggaaatccccaacagcttggaaatcagaagaacctttgccgccaatctggagaaggccaacttattgccaaagggtgatcccgaaagaagaaggctactgagcatcgtcgtcgttggtggaggccccactggcgtagaagccgctggtgagctgcaggattatgtgcaccaggacctgcggaagtttctccccgcattggccgaggaagtccaaattcacttggtcgaagccctgcccatcgttctgaacatgtttgagaaaaagctgtcatcatacgcgcaaagccacctggaaaacacctcgatcaaggtgcatctgagaaccgccgtcgccaaagttgaagagaagcaattgttggcaaagaccaaacacgaagacggcaaaataaccgaagaaactatcccctacggtactctgatttgggccacgggcaacaaggcaagacccgtaatcactgaccttttcaagaaaatccccgagcaaaactcgtccaagagaggattggcagtgaatgacttcttgcaggtgaaaggcagcaacaacattttcgccattggtgacaacgcatttgctgggttgccaccaaccgcccaggtagcgcaccaggaggccgaatacttggccaagaattttgataaaatggctcagataccaaatttccagaagaatctatcttcacggaaggataaaattgatctcttgttcgaggagaacaacttcaagcctttcaaatacaacgatttaggtgccttagcatacctgggctccgaaagagccattgcaaccatacgtagcggtaagagaaccttttacaccggtggtggcctgatgaccttctacttatggagaattttgtacctgtccatgattctatctgcacgctcgagattaaaggtctttttcgactggatcaaattagcctttttcaagagagactttttcaaaggcttatag

SEQ ID NO: 10 - DNA, 1542 bp, Artificial Sequence
  source: /note="Description of Artificial Sequence: Synthetic polynucleotide"
atgctaagcaagaatttgtatagtaacaagaggttgctgacctcgacgaacacgctagtgagattcgcttccaccagatccacaggggtcgaaaactccggagcaggtcctaccagcttcaagaccatgaaggtcattgaccctcagcacagcgacaagccaaacgtgctgatactgggttcggggtggggcgctattagctttttaaagcacattgacaccaagaagtacaacgtctccatcatctctcccagaagctacttcttatttacgcctctgttacctagcgcaccagttgggaccgtagacgaaaagtcaattatcgagcccatcgttaacttcgctctcaagaaaaagggcaacgttacctactatgaggcagaggccacctctatcaatcccgaccggaataccgttaccataaaaagcctgtctgccgtgtcccagctataccaacctgagaaccacctgggcctgcatcaagccgaacctgccgagattaagtacgattatctgatcagcgctgtgggtgcggaacccaacacatttggtattcccggggtgactgattacggccatttcctgaaggagattcccaactctttggaaataagaagaacttttgccgccaatctggagaaggccaacctgttgccaaagggtgatcccgagcggagaaggctactgagcattgtcgtcgttggtggtgggcctacaggtgtagaggccgctggtgaactgcaggactacgttcaccaggacctgagaaagttcctgcctgcattggccgaagaagtccaaattcacttggtcgaagccctgcccatcgttttgaatatgtttgagaaaaagcttagctcatacgcgcagtcacatttagaaaacacttccatcaaagtacatctgagaacggctgtggccaaggttgaagagaagcaattgttggccaagaccaaacacgaagacggtaagattaccgaagaaactattccatacggtactttgatttgggccacgggcaacaaggccagaccggtaatcaccgaccttttcaagaagattcctgagcaaaacagctccaagagaggattggcagtgaatgactttctgcaggtgaaaggcagcaacaacattttcgccattggtgacaatgcctttgccggcctgcctccaaccgcccaagtagcgcaccaagaggccgaatatttggccaagaattttgataagatggctcaaataccaaatttccaaaagaatctatcctcaagaaaggataaaatcgacctcttgttcgaggagaacaacttcaagcctttcaaatacaacgatttaggcgccttagcctacctgggatccgaaagggccattgcaaccataagatccggtaagagaaccttttacaccggtggtggcttaatgaccttctacctgtggcggatcctgtacctgtccatgattctatctgcaagaagcagactgaaggtctttttcgactggattaaactggccttcttcaaaagagacttttttaaaggcttatga

SEQ ID NO: 11 - DNA, 1542 bp, Artificial Sequence
  source: /note="Description of Artificial Sequence: Synthetic polynucleotide"
atgctgtcgaagaatttgtacagtaacaagcggctgctcacctcgacgaataccctcgtcagattcgcttccaccagatccacaggggtcgaaaacagcggagcaggccctacaagctttaagaccatgaaggtcattgacccccagcacagcgacaagccaaacgtgctgatcctgggttcggggtggggagctatttcgtttttaaagcacattgacaccaagaagtacaacgttagcatcatctctcctagaagctatttcttattcacccccctgttaccctctgcacctgttgggacagtagacgaaaagtcaatcattgagcccatcgttaattttgccctcaagaaaaaggggaacgttacctactacgaggcagaggccaccagcatcaatcccgacaggaataccgttaccataaagtcattatctgccgttagccagctgtaccagcctgagaaccatctagggctgcatcaagcagaacccgctgaaattaagtacgactacctgatcagtgctgtaggtgcggaacctaacacatttggtattcccggggtcactgattacggtcacttcctgaaggaaatccccaactctctggaaataagaagaaccttcgccgccaatctggagaaggctaacttattgccaaagggtgaccccgaacggagaagactactgagcattgtggtggttggtggtgggcccactggtgtagaggccgctggcgaactacaggattatgttcaccaggacctgagaaagttcctgcccgccttggccgaagaagtccaaattcacttggtcgaagctctgcccatcgttctgaacatgttcgagaagaagctgtcaagctacgcccaatcacacttagaaaacacttccatcaaggtacatctgagaacggctgtggccaaggtggaagaaaagcaattgctggccaagaccaagcacgaagacggtaaaataaccgaggaaactattccatacggcaccctgatttgggccaccggtaacaaggcaagaccggtaatcactgaccttttcaagaaaattcctgagcaaaactcgagcaagcggggattggcagtgaatgactttttgcaggtgaaaggcagcaacaacattttcgccattggtgacaatgcatttgctgggttgccacctaccgcccaggtggcccaccaggaggccgaatacttggccaagaactttgacaaaatggctcaaatacccaatttccaaaagaatctgtcttcccggaaggataagattgatctcctgttcgaggagaacaactttaaacctttcaaatacaacgatttaggtgccttagcatacctgggatccgaaagagccattgcaaccatacgttccggtaagagaacattttacaccggcggaggcttaatgaccttctacctgtggagaattctgtacctgagcatgatcctgtctgcaagatcgagattaaaggtctttttcgactggatcaaattagcatttttcaaaagggacttttttaaaggactgtag

SEQ ID NO: 12 - DNA, 1542 bp, Artificial Sequence
  source: /note="Description of Artificial Sequence: Synthetic polynucleotide"
atgctatcgaagaatttgtacagtaacaagaggttgctcaccagcaccaacacgctagtgcgcttcgctagcaccagatccacaggcgtggaaaactccggagcaggtcctacatctttcaagaccatgaaagtcattgaccctcagcacagcgacaaaccaaacgtgctgatactgggctcgggctggggagctattagctttttaaagcacattgacaccaagaagtacaacgtttccatcatctctcctagaagctacttcttatttacgcccttgttaccttctgcaccagtgggaacagtagacgaaaagtcaattatcgagcccatcgttaattttgctctcaagaaaaaggggaacgttacctactacgaggcagaggccacctctatcaatcccgacaggaataccgttaccataaagagcttatctgccgttagccagctgtaccagcctgaaaaccacctagggctgcaccaggcagagcctgctgaaattaagtacgattatctgatcagtgctgtaggcgcggaacccaacacatttggaatccccggggtgactgactacggtcatttcctgaaggaaattcccaactctctggaaataagacggactttcgccgccaacctagagaaggctaacttattgcctaagggtgatcccgaacggagaagactgctgtccattgtcgtggttggtggtgggcccacaggtgtggaggccgctggtgaactacaggattacgttcaccaggacctgcggaagtttctgcctgcattggccgaagaagtgcagattcacttggtggaagccctgcccatcgtgttgaatatgtttgagaagaagctttcaagctacgcgcaaagccatttagaaaacacctcgatcaaagtacatctgagaacggccgtggccaaagttgaagaaaagcagttgttggcaaagaccaagcacgaggacggcaaaataaccgaagaaactattccctacggtactttgatttgggccacgggtaacaaggcaagaccggtaatcactgaccttttcaagaaaattcctgagcaaaactcgtccaagcggggattggccgtgaatgactttttgcaggtcaaaggcagcaacaacattttcgccatcggtgacaacgcatttgccgggttgccaccaacagcccaagtagcccaccaagaggccgaatatttggccaagaatttcgataagatggctcaaatcccaaatttccagaagaatctgtcttcacggaaggataaaattgacctcttgttcgaggagaacaactttaaacctttcaagtacaacgacttaggtgccctggcatacctgggaagcgaaagggccattgccaccataagatccggtaagcggacattttacaccggcggaggcttaatgaccttctacctgtggagaattttgtacttgtccatgattctgagcgccagatcgagattaaaggtcttcttcgactggatcaagttagcatttttcaaaagggactttttcaagggactgtga

SEQ ID NO: 13 - DNA, 1542 bp, Artificial Sequence
  source: /note="Description of Artificial Sequence: Synthetic polynucleotide"
atgctgtcgaagaatttgtatagcaacaagaggctgctcacctcgacgaacacgctagtgagattcgcttccaccagatccacaggcgtggaaaactccggagctggtcccacaagctttaagaccatgaaagtcatcgaccctcagcacagcgacaaacccaacgtgctgatactgggctcggggtggggagccattagctttttaaagcacattgacaccaagaagtacaacgttagcatcatcagccctagaagctacttcttatttacccctttgttaccttctgcacctgttgggaccgtggacgaaaagtccatcattgagcccatcgttaatttcgctctgaagaaaaaggggaacgtcacctactatgaggcagaagccaccagcatcaatcccgaccggaacaccgtgaccataaaaagcttaagcgccgtttcccagctataccaacctgagaaccatctggggctgcatcaagccgaacctgctgaaattaagtacgattatttaatcagcgctgtaggtgcggaacctaacacatttggtatccctggggtgactgattacggtcatttcctgaaagaaattcccaactctttggaaataagaagaactttcgccgccaatctagagaaggctaacttattgcctaagggtgatcccgaaagaagaagactactgtccattgtcgtggttggtggagggcctactggtgtagaagccgctggtgaactacaggactatgttcaccaggacctgagaaagttcctccccgccctggccgaagaagtccagattcacctggtcgaagctctgcccatcgttttgaatatgtttgagaaaaagcttagctcatacgcgcaaagccacttagaaaacacctccatcaaagtgcacctgagaaccgctgtcgccaaagttgaagaaaagcaattgctggcaaagaccaaacacgaagacggtaagataaccgaagaaaccattccatacggtaccttgatttgggccaccggcaacaaggcaagaccggtgatcactgacctgttcaagaaaattcctgagcaaaactcgtccaagagaggcttggcagtgaatgactttttgcaggtgaaaggcagcaacaacattttcgccatcggcgacaacgcatttgctggcctgcctccaaccgcccaagtagcgcaccaagaggccgagtacttggccaagaacttcgacaaaatggctcaaataccaaatttccaaaagaatctatcttcaagaaaggataaaatcgacctcctgttcgaggagaacaactttaaacctttcaaatacaacgatctgggcgccttagcctacctgggctccgaaagggccattgccaccatacgtagcggcaagagaaccttttacaccggtggaggcttaatgaccttctacttatggagaattctgtacttgtccatgatcctaagcgcaagaagcagattaaaggtctttttcgactggattaaattagcctttttcaaaagggacttctttaagggcttatag

SEQ ID NO: 14 - DNA, 1542 bp, Artificial Sequence
  source: /note="Description of Artificial Sequence: Synthetic polynucleotide"
atgctatcgaagaatttgtatagtaacaagaggttgctgacctcgaccaatacgctagtcagattcgcttccaccagatccacaggggtggaaaactccggggcaggccctacatctttcaagaccatgaaggtcatcgacccccagcacagcgacaaaccaaacgtgctgatactgggttctgggtggggcgccatttcgtttttaaagcacatcgacaccaagaagtacaacgtctccatcatctctcctagaagctatttcttattcacgcctctgttaccctctgcccctgttgggaccgtagacgagaagtcaattatcgagcccatcgtgaactttgctctcaagaaaaaggggaacgtcacctactacgaggccgaagccaccagcatcaatcccgaccggaataccgttaccataaaatcattatctgccgttagccagctataccaacctgagaaccatctagggctgcatcaagcagaacctgccgagattaagtacgactatctgatcagcgccgtaggtgccgaacctaacacctttggtattcctggggtcactgattacggtcatttcctgaaggagattcccaactctttggaaatcagaagaacttttgccgccaatctagagaaggctaacttactgccaaagggcgatcccgaaagaagaagactactgtccattgtcgtggtgggtggtgggcctactggcgtagaagccgctggcgagctgcaggattatgttcaccaggacctgagaaagtttctccctgccttggccgaagaagtccaaattcacttggtggaagctctgcccatcgtgttgaacatgttcgagaaaaagctttcatcatacgcccaatcacacttagaaaacacttcgatcaaagtgcatctgagaacggctgtcgccaaagttgaagagaagcaactgctggccaagaccaagcacgaagacggtaaaattaccgaggaaaccattccctacggtactttgatttgggccacgggcaacaaggccagaccggtaatcaccgaccttttcaagaaaattcctgagcaaaacagctccaagagaggcctggcagtgaatgactttttgcaggtgaaaggcagcaacaacatcttcgccattggtgacaatgcatttgccggcttgccaccaaccgcccaggtagcgcaccaagaagccgagtacctggccaagaattttgataaaatggctcaaatacccaatttccagaagaatctgtcctccagaaaggataaaattgatctcctgttcgaggagaacaactttaagcctttcaaatacaacgatttaggcgccctggcctacctgggctccgaaagagccattgccaccatacgttccggtaagagaacattttacaccggtggtggcttaatgaccttctacttatggcggattttgtacttgagcatgattctatctgcaagaagcagattaaaggtctttttcgactggattaagctggcctttttcaaaagagacttctttaaaggactgtga

SEQ ID NO: 15 - DNA, 1542 bp, Artificial Sequence
  source: /note="Description of Artificial Sequence: Synthetic polynucleotide"
atgctatcgaagaatctgtatagtaacaagaggctgctcaccagcacgaataccctagtccgcttcgcctccaccagatccaccggcgtggaaaactccggagcaggtcctacatcttttaagaccatgaaggtcatcgacccccagcacagcgacaaaccaaacgtgctgatactgggttcgggctggggcgctatttcgtttttaaagcacattgacaccaagaagtacaacgtttccatcatcagccccagaagctatttcttatttacgcctttgttaccttctgcccctgttgggaccgtagacgaaaagtcaattatcgagcccatcgtgaatttcgctctcaagaaaaagggcaacgttacctactatgaggcagaagccacctctatcaatcccgaccggaacaccgttaccataaagagcttatctgccgttagccagctataccagcctgaaaaccatctggggctgcatcaagcagagcccgctgaaattaagtacgattatctgatcagtgctgtaggtgccgaacctaacacatttggtattcctggcgtcactgactacggtcacttcctgaaagaaattcccaactctttggaaatacggagaactttcgccgccaacctggagaaggccaacctgttgcctaagggtgatcccgaaagaagaagactactgtccattgtggtggttggtggtggccctactggtgtggaggctgctggtgagctacaggattatgttcaccaggacctgagaaagtttctccctgcattggccgaagaagtgcaaattcacttggtcgaagccctgcccatcgttctgaatatgtttgagaaaaagcttagcagctacgcccaaagccacttagaaaacacctccatcaaagtacacctgagaaccgctgtcgccaaagtggaagaaaagcaattgttggcaaagaccaaacacgaggacggtaagattaccgaggaaactattccctacggtactttgatttgggccaccggtaacaaggcaagacccgtaatcactgaccttttcaagaagattcctgagcagaacagcagcaagagaggattggccgtgaacgacttcctgcaggtgaaaggcagcaacaacatcttcgccattggcgacaacgcctttgctgggttgccaccaaccgcccaagtagcccaccaagaggccgaatatttggccaagaatttcgataagatggctcaaatacccaatttccaaaagaatctgtcctcaagaaaggataaaatcgatctcttgttcgaggaaaacaactttaagcccttcaaatacaacgatttaggtgccctggcatacctgggatccgaaagggccattgcaaccataagatccggcaagagaacattttacaccggcggaggcttaatgaccttctacctgtggagaattttgtacctgtccatgattctaagcgcaagatcgagattaaaggtcttcttcgactggatcaaattagcatttttcaaaagagacttttttaaaggattatag

SEQ ID NO: 16 - DNA, 1542 bp, Artificial Sequence
  source: /note="Description of Artificial Sequence: Synthetic polynucleotide"
atgctgagcaagaacctgtatagtaacaagcggttgctgacctcgaccaataccctcgtcagattcgcttccaccagatccacaggggtggaaaactccggggcaggccctacctctttcaagaccatgaaagtcattgaccctcagcacagcgacaagccaaacgtgctgatactgggttcggggtggggagccatttcgtttttaaagcacattgacaccaagaagtacaacgttagcatcatctctcctagaagctatttcctgtttacgcctttgttaccctctgcaccagttgggacagtggacgaaaagtcaatcattgagcccatcgtgaattttgctctcaagaaaaagggcaacgttacctactatgaggcagaagccacctctatcaaccccgacaggaacaccgtgaccataaaaagcttatctgccgttagccagctataccaacctgaaaaccatctggggctgcatcaagcagaacctgctgaaattaagtacgattacctgatcagtgccgtgggcgcggaacccaacacatttggtatccctggcgtcactgattacggtcatttcctgaaggagatccccaactctttggaaatacggagaacttttgccgccaatctagagaaggctaacctgctgccaaagggtgaccccgaaagaagaagactgctgtccatcgtcgtcgttggtggagggcctactggtgtagaggccgctggtgaactgcaggattatgttcaccaggacctgcggaagttcctccccgcattggccgaggaagtccagattcacttggtcgaagctctgcccatcgttctgaacatgtttgagaaaaagctttcatcatacgcccagtcacacctggaaaacacttcgatcaaggtacatctgagaacggctgtcgccaaggttgaagaaaagcaactgctggcaaagaccaaacacgaagacggtaagataaccgaagaaaccattccctacggcactctgatttgggccacgggtaacaaggcaagaccggtaatcaccgaccttttcaagaagattcctgagcagaacagctccaagcggggattggcagtgaatgactttctgcaggtgaaaggcagcaacaacattttcgccattggtgacaacgcctttgctgggctgccaccaacagcccaagtagcgcaccaggaagccgaatatttggccaagaacttcgataagatggctcagatcccaaatttccaaaagaatctatcctcaagaaaggataaaattgatctcctgttcgaggagaacaactttaagcccttcaagtacaacgatttaggtgccctggcctacctgggatccgaaagggccattgcaaccatccgttccggtaagagaaccttttacaccggtggaggcctgatgaccttctacttatggagaattttgtacttgtccatgattctatctgcacgctcgagactgaaggtctttttcgactggattaaattagcctttttcaaaagggacttctttaagggattatag

SEQ ID NO: 17 - DNA, 1542 bp, Artificial Sequence
  source: /note="Description of Artificial Sequence: Synthetic polynucleotide"
atgctaagcaagaatttgtatagtaacaagaggttgctgaccagcacgaatacgctagtccgcttcgcttccaccagatccaccggggtggaaaactccggggcaggccctacatctttcaagaccatgaaagtcattgaccctcagcacagcgacaagcccaacgtgctgatactgggttcggggtggggagctatctcgtttctgaagcacattgacaccaagaagtacaacgtttccatcatcagccctagaagctacttcttatttacgcctctgttaccttctgcaccagtgggaacagtggacgaaaagtccatcatcgagcccatcgttaacttcgccctcaagaaaaagggcaacgtcacctactatgaggcagaagccacctctatcaatcccgacaggaataccgtgaccataaaaagcttaagcgccgttagccagctgtaccagcctgaaaaccatctgggcctgcatcaggcagaacctgccgaaattaagtacgattatctgatcagtgctgtaggtgcggaacccaacacatttggtattcctggggtgaccgattacggccatttcctgaaggaaattcccaactctttggaaataagacggacttttgccgccaatctggagaaggctaacttactgccaaagggtgatcccgaaagaagaaggctactgtccatcgtcgtggtgggtggtgggcctactggtgtagaggccgctggtgaactacaggattatgtgcaccaggacctgagaaagtttctgcctgcactggccgaagaagtccaaattcacttggtggaagctctgcccatcgttttgaatatgtttgagaaaaagctgagctcatacgcgcaaagccacctggaaaacacctcgatcaaggtacatctgagaaccgctgtcgccaaggttgaagaaaagcaattgttggccaagaccaagcacgaggacggcaagataaccgaagaaactatcccctacggcactctgatttgggccaccggcaacaaggcaagacccgtaatcactgacctgttcaagaaaattcccgagcaaaactcgtccaagagaggattggcagtgaatgactttttgcaggtcaaaggcagcaacaacattttcgccatcggtgacaatgcctttgctgggttgccacctaccgcccaagtagcgcaccaagaagccgaatacttggccaagaatttcgacaaaatggctcaaataccaaatttccaaaagaatctgtcctccagaaaggataagatcgatctcttgttcgaggaaaacaactttaaacctttcaaatacaacgatttaggtgccttagcatacctgggaagcgaaagagccattgcaaccataagaagcggtaagagaacattttacaccggtggaggcttaatgaccttctacttatggagaatcttgtacctgtccatgattctatctgcacgcagcagattaaaggtcttcttcgactggattaaattagcatttttcaagagagacttttttaagggcttatag

SEQ ID NO: 18 - DNA, 1542 bp, Artificial Sequence
  source: /note="Description of Artificial Sequence: Synthetic polynucleotide"
atgctaagcaagaatttgtatagtaacaagcggttgctcacctcgacgaacaccctagtcagattcgcttccaccagatccacaggggtcgaaaacagcggagcaggtcctacatctttcaagaccatgaaagtcattgacccccagcacagcgacaaacccaacgtgctgatactgggttcgggctggggagctatcagctttttaaagcacatcgacaccaagaagtacaacgtttccatcatctctcctagaagctatttcctgtttacgcccttgttaccttctgcaccagtggggacagtggacgaaaagtccattatcgagcccatcgttaatttcgctctcaagaaaaagggcaacgttacctactatgaggcagaggccaccagcatcaatcccgaccggaataccgttaccataaagtcactgtctgccgtttcccagctataccaacctgaaaaccatctaggcctgcatcaggcagaacccgccgaaattaagtacgattatttaatcagtgctgtaggcgcggaacccaacacatttggtattcccggcgtcactgactacggtcatttcctgaaagagattcccaactctttggaaataagacggacttttgccgccaatctagagaaggccaacttattgccaaagggtgatcccgaaagaagaagactactgtccatcgtcgtggttggtggtgggcctacaggtgtagaggccgctggtgaactgcaggattatgttcaccaggacctgagaaagtttctgcctgcactggccgaggaagtccaaattcacctggtcgaagctctgcccatcgtgttgaatatgttcgagaagaagcttagctcatacgcccaaagccatttagaaaacacttcgatcaaggtgcacctgagaacggctgtggccaaagtggaagaaaagcagctgctggccaagaccaaacacgaagacggtaaaataaccgaagaaactatcccatacggtactctgatttgggccaccggtaacaaggcaagacccgtaatcactgaccttttcaagaagattcctgagcaaaactcgtccaagagaggattggcagtgaatgacttcttgcaggtcaaaggcagcaacaacattttcgccatcggtgacaatgcctttgctggcctgccacctaccgcccaagtagcgcaccaggaggccgagtatctggccaagaatttcgataagatggcccagataccaaatttccaaaagaatctgtcttcaagaaaggataaaattgatctgctgttcgaggaaaacaacttcaaacctttcaaatacaacgatttaggtgccctggcatacctgggaagcgaaagagccattgcaaccatacgttccggtaagagaaccttttacaccggtggtggcttaatgaccttctacttatggagaatcctgtacttgtccatgatcctgagcgccagatcgagattaaaggtctttttcgactggattaaattagcatttttcaaaagagacttttttaagggcctgtga

SEQ ID NO: 19 - DNA, 1542 bp, Artificial Sequence
  source: /note="Description of Artificial Sequence: Synthetic polynucleotide"
atgctatcgaagaatctgtacagtaacaagaggttgctcacctcgaccaacacgctcgtcagattcgcttccaccagatccacaggggtggaaaactccggagctggtcctacatctttcaagaccatgaaggtcattgaccctcagcacagcgacaagccaaacgtgctgatactgggctcggggtggggcgctatcagctttctgaagcacattgacaccaagaagtacaacgtcagcatcatcagccctagaagctacttcttatttacgcctctgttacctagcgccccagttgggacagtagacgaaaagtcaattattgagcccatcgttaattttgccctcaagaaaaaggggaacgttacctactacgaggcagaagccacctctatcaatcccgacaggaataccgttaccataaaaagcctgtctgccgttagccagctgtaccaacctgaaaaccatctagggctgcatcaagccgaacctgctgaaattaagtacgattatctgatcagcgctgtgggtgcggaacccaacacctttggtatccccggggtcactgattacggccatttcctgaaagagattcccaactctttggaaatcagaagaacttttgccgccaatctagagaaggctaacttactgccaaagggtgatcccgagagaagaaggctactgtccattgtcgtcgttggtggaggccctactggcgtggaggctgctggcgaactacaggactatgttcaccaggacctgcggaagtttctccccgcactggccgaggaagtgcaaattcacttggtcgaagccctgcccatcgtgctgaatatgttcgagaaaaagcttagctcatacgcgcaaagccatttagaaaacacctccatcaaagtacacctgagaaccgctgtggccaaggtggaagagaagcagttgttggcaaagaccaaacacgaagacggtaagattaccgaagaaactattccatacggtaccttgatttgggccacgggcaacaaggcaagaccggtaatcaccgaccttttcaagaaaattcccgagcagaactcgtccaagcggggattggcagtgaatgactttttgcaggtgaaaggcagcaacaacattttcgccatcggcgacaatgcatttgctggcttgccaccaacagcccaagtagcgcaccaagaggccgaatatctggccaagaatttcgataaaatggctcaaataccaaatttccaaaagaacctatcttccagaaaggataaaatcgatctcttgttcgaggagaacaacttcaaacctttcaaatacaacgatttaggcgccttagcatacctgggcagcgaaagggccattgcaaccataagatccggtaagagaaccttttacaccggtggtggcttaatgaccttctacctgtggcggattttgtacttgtccatgattctatctgccagaagcagattaaaggtctttttcgactggattaaactggcatttttcaaaagggacttctttaaaggattatga

SEQ ID NO: 20 - DNA, 1542 bp, Artificial Sequence
  source: /note="Description of Artificial Sequence: Synthetic polynucleotide"
atgctaagcaagaatttgtatagtaacaagaggttgctgacctcgacgaataccctagtcagattcgcttccaccagatccacaggcgtggaaaactccggagctggccctacctcttttaagaccatgaaagtcattgacccccagcacagcgacaaaccaaacgtgctgatactgggttcggggtggggcgccatctcgtttttaaagcacatcgacaccaagaagtacaacgtctccatcatctctcctagaagctatttcttattcacgcctctgttaccctctgccccagtggggaccgtagacgaaaagtccattattgagcccatcgttaattttgccctgaagaaaaaggggaacgttacctactatgaggccgaggccacctctatcaatcccgaccggaataccgtgaccataaaatcactgagcgccgttagccagctataccaacccgaaaaccatctagggctgcaccaggcagaacctgccgagattaagtacgattacctgatcagtgctgtgggtgccgagcctaacacatttggtattcctggggtcactgattacggtcacttcctgaaggaaattcccaactctttggaaataagacggacttttgccgccaatctagagaaggccaacttattgccaaagggtgatcccgaaagaagaagactactgagcattgtcgtggttggtggtgggcccactggtgtggaggccgctggtgaactacaggattatgtgcaccaggacctgagaaagttcctgcctgcattggccgaagaagtccaaattcacctggtcgaagccctgcccatcgttttgaatatgtttgagaagaagctgtcatcatacgcgcaatcacatttagaaaacacttcgatcaaagtacacctgagaacggctgtcgccaaagttgaagaaaagcaactgctggccaagaccaaacacgaagacggcaaaataaccgaagaaactatcccatacggtactttgatttgggccacgggcaacaaggcaagaccggtaatcactgaccttttcaagaagatccctgagcaaaacagcagcaagagaggcttggccgtgaatgactttttgcaggtgaaaggcagcaacaacattttcgccatcggtgacaacgcatttgctggcctgccacctaccgcccaggtagcgcaccaggaagccgaatatttggccaagaatttcgataaaatggcccagatcccaaatttccagaagaacctgtcttcaagaaaggataagatcgatctgctgttcgaggagaacaactttaagcctttcaagtacaacgacctgggtgccttagcatacctgggaagcgaaagggccattgccaccatacgttccggtaagagaacattttacaccggcggaggcttaatgaccttctacctgtggagaattctgtacttgtccatgattctgagcgcaagatcgagattaaaggtcttcttcgactggattaaattagcatttttcaagagggacttcttcaaaggattatag

SEQ ID NO: 21 - DNA, 1542 bp, Artificial Sequence
  source: /note="Description of Artificial Sequence: Synthetic polynucleotide"
atgctaagcaagaacttgtatagtaacaagcggttgctgaccagcacgaatacgctagtcagattcgcttccaccagatccaccggcgtggaaaacagcggggcaggccctacaagctttaagaccatgaaggtcattgacccccagcacagcgacaaaccaaacgtgctgatactgggttcggggtggggagctatttcgtttttaaagcacatcgacaccaagaagtacaacgtttccatcatctctcctagaagctacttcctgtttacgcctctgttaccttctgccccagttgggacagtggacgaaaagtccatcatcgagcccatcgtgaattttgctctcaagaaaaagggcaacgtcacctactacgaggcagaagccacctctatcaaccccgacaggaataccgtgaccataaaatcattatctgccgtttcccagctgtaccaacctgaaaaccatctagggctgcatcaagccgagcccgctgagattaagtacgattatttaatcagtgccgtaggcgcggagcctaacacctttggtattcctggggtcactgattacggtcatttcctgaaagaaattcccaactctctggaaataagaagaacttttgccgccaatctggagaaggccaacctgttgccaaagggtgatcccgagcggagaagactgctgtccattgtcgtggtgggcggtgggcctacaggtgtggaagccgctggtgagctacaggactatgttcaccaggacctgcggaagtttctccctgccttggccgaagaagtccagattcacttggtcgaagctctgcccatcgtgttgaacatgtttgagaaaaagctgtcatcatacgcgcagagccacttagaaaacacttccatcaaagtacacctgagaacggctgtcgccaaagttgaagagaagcaattgttggcaaagaccaaacacgaagacggcaaaataaccgaagaaactattccctacggtactctgatttgggccaccggtaacaaggcaagaccggtaatcactgacctgttcaagaaaatccctgagcagaactcgtccaagcggggattggcagtgaatgactttttgcaggtgaaaggcagcaacaacattttcgccattggcgacaatgcatttgctgggttgccaccaacagcccaagtagcgcaccaagaggccgaatatttggccaagaactttgataaaatggctcaaataccaaatttccaaaagaatctgtcctcaagaaaggataaaattgatctgttgttcgaggagaacaactttaaacctttcaagtacaacgatctgggtgccttagcatacctgggatccgaaagggccattgccaccataagatccggtaagcggaccttctacaccggtggaggcttaatgaccttctacctgtggagaattttgtacctgtccatgatcctatctgcaagatcgagattaaaggtgttcttcgactggatcaagttagcatttttcaaaagggacttcttcaagggcttatga

SEQ ID NO: 22 - DNA, 1542 bp, Artificial Sequence
  source: /note="Description of Artificial Sequence: Synthetic polynucleotide"
atgctaagcaagaacttgtatagtaacaagcggttgctcaccagcaccaacaccctcgtgcgcttcgccagcaccagatccaccggcgtcgaaaacagcggggctggccccaccagctttaagaccatgaaggtcattgacccccagcacagcgacaagcccaacgtgctgatactgggctctggctggggagccatcagctttctgaagcacatcgacaccaagaagtacaacgtttccatcatcagccctagaagctatttcctgttcacgcccctgctgcccagcgcacctgtggggacagtagacgaaaagtccattatcgagcccatcgtgaatttcgccctcaagaaaaaggggaacgtcacctactatgaggcagaggccaccagcatcaatcccgaccggaacaccgttaccatcaagtcactgagcgccgtttcccagctataccagcctgagaaccacctgggcctgcaccaggccgaacccgccgaaattaagtacgactatttaatcagcgccgtgggtgccgaacccaacacatttggaatccccggcgtgactgactacggccatttcctgaaggagattcccaacagcctggaaatcagacggactttcgccgccaatctagaaaaggctaacctgttgcctaagggcgaccccgaacggagaagactgctgagcatcgtggtggttggcggtgggcccacaggcgtggaggccgctggcgagctgcaggactatgttcaccaggacctgcggaagtttctccctgccctggccgaagaagtccagattcacctggtcgaagccctgcccatcgtgctgaacatgttcgagaagaagctgagctcatacgcccagtcacatctggaaaacacctccatcaaggtgcatctgagaacggctgtcgccaaagtggaagaaaagcagctgttggcaaagaccaaacacgaagacggcaaaattaccgaggaaactatcccatacggtaccctgatttgggccaccggtaacaaggcaagaccggtgatcaccgacctgttcaagaaaattcccgagcaaaacagcagcaagagaggattggcagtgaatgacttcttgcaggtgaaaggcagcaacaacattttcgccatcggtgacaacgcctttgccgggctgccacctacagcccaggtggcgcaccaggaagccgagtacttggccaagaatttcgataagatggctcaaatacccaatttccaaaagaacctgtcctcccggaaggataaaatcgatctgttgttcgaggaaaacaacttcaagcctttcaaatacaacgatttaggtgccctggcctacctgggctccgaaagggccattgccaccataagaagcggcaagagaaccttctacaccggtggaggcctgatgaccttctacctgtggagaatcctgtacctgtccatgatcctgagcgccagaagcagactgaaggtgtttttcgactggatcaagctggcattcttcaaaagggacttttttaagggactgtga

SEQ ID NO: 23 - DNA, 1542 bp, Artificial Sequence
  source: /note="Description of Artificial Sequence: Synthetic polynucleotide"
atgctatcgaagaatctgtacagtaacaagcggctgctgaccagcaccaataccctcgtgcgcttcgcttccaccagatccaccggcgtcgaaaacagcggggctggccccaccagctttaagaccatgaaagtcatcgacccccagcacagcgacaagccaaacgtgctgatcctgggctcggggtggggagccatcagctttttaaagcacatcgacaccaagaagtacaacgtcagcatcatctctcctagaagctacttcctgtttacccctctgctgcccagcgcacctgtgggaacagtagacgagaagtccatcatcgagcccatcgttaactttgctctcaagaaaaagggcaacgtcacctactatgaggccgaggccacctctatcaatcccgacaggaacaccgttaccatcaaaagcctgagcgccgtgagccagctataccagcctgaaaaccacctggggctgcaccaggcagaacctgctgaaattaagtacgactatctgatcagcgccgtgggtgccgagcccaacacctttggtattcccggggtcactgattacggccatttcctgaaagagattcccaactctttggaaatcagacggactttcgccgccaatctggaaaaggccaacctgttgccaaagggtgatcccgagcggagaaggctgctgagcattgtcgtcgttggtggtggccctacaggcgtggaggctgctggcgagctacaggactacgtgcaccaggacctgagaaagtttctgcccgccctggccgaggaagtgcaaattcacctggtcgaagctctgcccatcgttctgaatatgttcgagaaaaagctgagcagctacgcgcagagccacttagaaaacacctccatcaaagtgcacctgagaaccgctgtggccaaagtggaagagaagcagttgttggcaaagaccaagcacgaggacggtaagataaccgaggaaaccatcccatacggcactctgatttgggccaccggtaacaaggcaagacccgtgatcaccgacctgttcaagaagatccccgagcagaacagctccaagcggggactggcagtgaacgactttctgcaggtcaaaggcagcaacaacatcttcgccatcggcgacaacgcctttgctggcttgcctccaacagcccaggtggcccaccaggaggccgaatacctggccaagaatttcgataagatggcccaaatccccaatttccagaagaatctgtcctcacggaaggataaaatcgatctcctgttcgaggaaaacaactttaagcccttcaaatacaacgacctgggcgccttagcatacctgggctccgaaagggccattgccaccatccgttccggtaagcggacattctacaccggcggtggcctgatgaccttctacctgtggagaatcttgtacctgagcatgatcctaagcgcccgcagcagattaaaggtgtttttcgactggatcaaattagcattcttcaagagggactttttcaaaggcttatga

SEQ ID NO: 24 - DNA, 1542 bp, Artificial Sequence
  source: /note="Description of Artificial Sequence: Synthetic polynucleotide"
atgctgagcaagaatctgtatagtaacaagcggctgctcaccagcacgaacacgctagtgcgcttcgctagcaccagatccaccggcgtcgaaaacagcggagctggtcctaccagctttaagaccatgaaggtcatcgaccctcagcacagcgacaaaccaaacgtgctgatcctgggttctggctggggcgccatcagctttttaaagcacattgacaccaagaagtacaacgttagcatcatcagccccagaagctatttcctgtttacccccctgttacctagcgcccctgttgggaccgtagacgagaagtcaatcatcgagcccatcgttaatttcgctctgaagaaaaaggggaacgttacctactacgaggccgaggccacctctatcaaccccgaccggaacaccgtgaccatcaagagcttaagcgccgttagccagctgtaccagcccgaaaaccatctaggcctgcaccaggccgagcccgccgaaattaagtacgattacttaatcagtgccgtgggtgcggagcctaacacctttggaatccccggggtgactgattacggccacttcctgaaggagattcccaactctttggaaatccggcggaccttcgccgccaatctggaaaaggccaacctgctgcctaagggcgatcccgagagaagaagactactgagcatcgtcgtcgttggtggaggccccactggtgtagaggccgctggcgagctgcaggactacgtgcaccaggacctgcggaagtttctccccgcactggccgaagaagtgcagattcacctggtggaagccctgcccatcgtgctgaacatgttcgagaagaagcttagctcatacgcccaatcacacctggaaaacacctccatcaaagtgcatctgagaaccgccgtggccaaagtggaagaaaagcaattgctggcaaagaccaaacacgaggacggcaaaattaccgaagaaaccatcccctacggcaccctgatttgggccaccggtaacaaggcaagacccgtaatcaccgacctgttcaagaaaattcccgagcaaaactcgagcaagcggggactggccgtgaatgactttctgcaggtgaaaggcagcaacaacattttcgccatcggcgacaacgcatttgccggcttgcctccaacagcccaagtggcccaccaagaagccgagtacctggccaagaacttcgacaaaatggcccaaatacccaatttccaaaagaacctgtcttcacggaaggataagattgatctcctgttcgaggaaaacaacttcaagcccttcaagtacaacgacctgggcgccctggcatacctgggcagcgaaagagccattgcaaccatccgtagcggcaagagaaccttttacaccggcggaggcctgatgaccttctacttatggcggattctgtacctgagcatgatcctaagcgccagatcgagattaaaggtcttcttcgactggattaagttagcattcttcaagagagacttcttcaaaggattatga

SEQ ID NO: 25 - DNA, 1542 bp, Artificial Sequence
  source: /note="Description of Artificial Sequence: Synthetic polynucleotide"
atgctgagcaagaacttgtacagcaacaagaggttgctcaccagcacgaacaccctcgtccgcttcgccagcaccagatccaccggcgtggaaaacagcggagctggccccacctcttttaagaccatgaaggtcattgacccccagcacagcgacaagccaaacgtgctgatactgggctcgggctggggcgccatctcgtttctgaagcacattgacaccaagaagtacaacgtttccatcatcagccccagaagctacttcttatttacccccctgctgcccagcgcaccagtgggaacagtggacgaaaagtcaatcattgagcccatcgtgaactttgccctgaagaaaaaggggaacgttacctactacgaggcagaggccaccagcatcaatcccgaccggaataccgtgaccatcaagagcttatctgccgttagccagctataccagcccgaaaaccacctggggctgcaccaggccgagcctgccgagattaagtacgactacctgatcagtgccgtgggcgcggagcccaacacctttggtattcctggcgtgactgactacggccacttcctgaaagagatccccaacagcctggaaataagacggacctttgccgccaatctggaaaaggctaacttactgcctaagggcgatcccgagcggagaagactgctgagcatcgtggtggtgggtggaggccctacaggtgtggaagctgctggcgagctgcaggactatgttcaccaggacctgcggaagttcctccccgccttggccgaggaagtgcaaattcacctggtggaagccctgcccatcgttctgaatatgtttgagaaaaagctgagctcatacgcccaatcacacttagaaaacacctccatcaaagtgcacctgagaaccgccgtcgccaaggtggaagagaagcagctgctggccaagaccaaacacgaggacggcaagattaccgaggaaactattccctacggtaccttgatttgggccacgggtaacaaggcaagaccggtgatcactgacctgttcaagaagattcccgagcagaacagctccaagagaggcttggcagtgaatgacttcctgcaggtcaaaggcagcaacaacattttcgccatcggtgacaacgcctttgccgggctgccacctacagcccaagtggcgcaccaagaagccgagtatttggccaagaatttcgacaaaatggcccagatacccaatttccaaaagaacctatcctccagaaaggataagatcgatctgctgttcgaggagaacaacttcaagcccttcaaatacaacgacttaggtgccttagcctacctgggctccgaaagggccattgccaccatcagaagcggtaagcggacattctacaccggcggtggcctgatgaccttctacttatggcggattctgtacctgtccatgatcctgtctgccagaagcagactgaaggtctttttcgactggatcaagttagcatttttcaagagagacttcttcaaaggactgtag

SEQ ID NO: 26 - DNA, 1542 bp, Artificial Sequence
  source: /note="Description of Artificial Sequence: Synthetic polynucleotide"
atgctgtcgaagaacttgtatagcaacaagcggctgctcaccagcacgaacacgctagtgagattcgccagcaccagatccaccggcgtggaaaactccggagctggccccacaagctttaagaccatgaaggtcatcgacccccagcacagcgacaagcccaacgtgctgatactgggctctggctggggcgctatctcgtttttaaagcacattgacaccaagaagtacaacgttagcatcatcagccccagaagctatttcttattcacccccctgctgccctctgcaccagttggaacagtggacgagaagtcaatcatcgagcccatcgtgaactttgccctgaagaaaaagggcaacgttacctactatgaggccgaagccacctctatcaaccccgacaggaataccgttaccataaagagcctgtctgccgtgtcccagctgtaccaacctgaaaaccacctagggctgcaccaggcagaacccgccgagattaagtacgactacttaatcagtgccgtaggcgcggagcccaacacctttggtatccctggcgtgactgactacggtcacttcctgaaggagattcccaactctctggaaatcagaagaactttcgccgccaacctagaaaaggccaacttattgcctaagggtgatcccgaacggagaaggctgctgagcatcgtggtcgtgggtggagggcccactggcgtggaagccgctggcgagctgcaggactatgtgcaccaggacctgagaaagtttctccctgcattggccgaggaagtgcaaattcacctggtggaagccctgcccatcgtgctgaacatgttcgagaagaagctgagcagctacgcccaaagccacttagaaaacacctccatcaaggtgcacctgagaaccgctgtggccaaggttgaagaaaagcagttgctggcaaagaccaagcacgaggacggtaaaattaccgaagaaaccatcccctacggtactttgatttgggccaccggcaacaaggcaagacccgtgatcaccgacctgttcaagaagatccccgagcaaaacagcagcaagcggggcttggccgtgaacgactttctgcaggtcaaaggcagcaacaacatcttcgccatcggtgacaacgcctttgccgggttgccacctaccgcccaggtggcgcaccaggaggccgagtatttggccaagaattttgataaaatggctcagatccccaatttccagaagaacctgtcctccagaaaggataagattgatctcctgttcgaggagaacaacttcaaacctttcaagtacaacgatctgggtgccctggcctacctgggcagcgaaagagccattgccaccatccgtagcggcaagagaacattctacaccggcggaggcctgatgaccttctacttatggcggattctgtacctgagcatgatcctgtctgccagaagcagactgaaggtgttcttcgactggatcaagttagcatttttcaaaagggacttctttaagggcctgtag

SEQ ID NO: 27 - DNA, 1542 bp, Artificial Sequence
  source: /note="Description of Artificial Sequence: Synthetic polynucleotide"
atgctgagcaagaacttgtacagcaacaagcggttgctgaccagcaccaataccctcgtccgcttcgctagcaccagatccaccggcgtggaaaacagcggagcaggtcccacaagctttaagaccatgaaggtcattgacccccagcacagcgacaaacccaacgtgctgatcctgggttcgggctggggcgccatcagctttctgaagcacattgacaccaagaagtacaacgtcagcatcatctctcccagaagctacttcctgtttacgcccttgctgcctagcgcccctgttggaaccgtagacgaaaagtccattattgagcccatcgttaacttcgccctgaagaaaaagggcaacgttacctactatgaggcagaagccaccagcatcaaccccgacaggaacaccgttaccatcaaatcactgtctgccgtgagccagctgtaccagcctgagaaccacctagggctgcaccaggccgagcctgccgagattaagtacgactatctgatcagcgctgtaggtgccgagcctaacacatttggaatccccggggtgactgattacggccatttcctgaaagagatccccaacagcctggaaatccggcggacttttgccgccaacctggaaaaggccaacctgttgcctaagggtgatcccgagcggagaaggctgctgagcatcgtggtcgttggcggtgggcctacaggtgtagaagctgctggtgagctgcaggattatgtgcaccaggacctgcggaagttcctccctgcactggccgaagaagtgcaaattcacttggtggaagctctgcccatcgtgctgaatatgttcgagaagaagctgtcaagctacgcgcaatcacatctggaaaacacctcgatcaaagtgcacctgagaaccgccgtggccaaagttgaagagaagcaactgctggccaagaccaagcacgaagacggcaaaattaccgaggaaaccattccctacggtaccctgatttgggccacgggcaacaaggcaagacccgtgatcaccgacctgttcaagaaaatccccgagcaaaacagcagcaagcggggcctggccgtgaacgactttctgcaggtcaaaggcagcaacaacatcttcgccattggcgacaatgcctttgctggcttgcctccaacagcccaggtggcgcaccaggaagccgagtatctggccaagaacttcgacaaaatggcccaaatacccaatttccaaaagaatctgtcctcacggaaggataaaattgacctgttgttcgaggagaacaacttcaaacccttcaagtacaacgatctgggcgccttagcatacctgggctccgaaagagccattgcaaccatcagaagcggcaagcggacattttacaccggtggaggcctgatgaccttctacctgtggagaatcctgtacttgagcatgattctaagcgccagaagcagattaaaggtgttcttcgactggatcaaactggcctttttcaagagagacttctttaagggcctgtag

SEQ ID NO: 28 - DNA, 1542 bp, Artificial Sequence
  source: /note="Description of Artificial Sequence: Synthetic polynucleotide"
atgctgagcaagaatttgtacagcaacaagaggctgctcaccagcaccaatacgctagtccgcttcgctagcaccagatccacaggggtcgaaaacagcggggcaggccctacaagctttaagaccatgaaggtcatcgacccccagcacagcgacaaaccaaacgtgctgatcctgggctctggctggggcgctatcagctttttaaagcacatcgacaccaagaagtacaacgtcagcatcatctctcccagaagctatttcttatttacccctctgttacctagcgcccctgttggaaccgtggacgagaagtcaatcatcgagcccatcgttaacttcgccctgaagaaaaagggcaacgtcacctactacgaggccgaagccaccagcatcaatcccgacaggaataccgtgaccatcaagagcctgagcgccgttagccagctataccaacccgaaaaccacctgggcctgcaccaagccgaacccgccgagattaagtacgattatctgatcagcgccgtaggcgcggagcccaacacatttggtatccccggcgtcaccgactacggccacttcctgaaggaaattcccaacagcttggaaataagacggacctttgccgccaatctagagaaggctaacctgctgccaaagggcgatcccgagagaagaaggctgctgagcatcgtcgtcgttggtggagggcctacaggcgtagaagctgctggcgaactacaggattacgtgcaccaggacctgagaaagtttctccctgccttggccgaggaagtccagattcacttggtggaagccctgcccatcgtgctgaatatgtttgagaagaagctgtcaagctacgcccaatcacatctggaaaacacctccatcaaagtgcatctgagaacggctgtggccaaagtggaagaaaagcagctgttggccaagaccaagcacgaggacggcaagataaccgaggaaaccattccctacggcaccttgatttgggccacgggtaacaaggcaagacccgtgatcaccgaccttttcaagaaaatccctgagcagaactcgtccaagagaggactggcagtgaacgacttcctgcaggtcaaaggcagcaacaacattttcgccatcggtgacaacgcctttgctggcctgcctcctacagcccaagtagcccaccaggaggccgagtatttggccaagaacttcgacaagatggcccaaatacccaatttccagaagaacctatcctcacggaaggataaaatcgacctgctgttcgaggaaaacaacttcaagcctttcaagtacaacgacctgggcgccttagcctacctgggcagcgaaagagccattgcaaccataagaagcggtaagcggaccttctacaccggcggaggcctgatgaccttctacctgtggcggatcttgtacttgagcatgatcctgtctgcccgcagcagactgaaggtgttcttcgactggattaagttagccttcttcaagagagacttctttaagggcctgtga

SEQ ID NO: 29 - DNA, 1542 bp, Artificial Sequence
  source: /note="Description of Artificial Sequence: Synthetic polynucleotide"
atgctaagcaagaacttgtacagcaacaagcggttgctgaccagcaccaacaccctcgtccgcttcgccagcaccagatccaccggcgtcgaaaacagcggagctggccccacatctttcaagaccatgaaggtcatcgacccccagcacagcgacaaaccaaacgtgctgatcctgggttctgggtggggagctatctcgtttttaaagcacatcgacaccaagaagtacaacgtcagcatcatcagccctagaagctacttcctgttcacgcctctgttacccagcgcaccagtggggaccgtagacgaaaagtccatcatcgagcccatcgtgaacttcgctctgaagaaaaagggcaacgtcacctactacgaggccgaggccaccagcatcaaccccgaccggaacaccgttaccatcaaaagcctgtctgccgttagccagctgtaccagcctgagaaccacctggggctgcaccaggcagagcctgctgagattaagtacgactatctgatcagtgccgtaggtgcggaacctaacacatttggtattcctggcgtgactgattacggccatttcctgaaagagatccccaacagcctggaaatcagaagaaccttcgccgccaatctggaaaaggccaacctgttgcctaagggtgaccccgaaagaagaaggctgctgagcatcgtggtcgtgggtggaggccccacaggtgtagaagctgctggcgaactgcaggactacgtgcaccaggacctgcggaagttcctccccgcattggccgaggaagtccagattcacttggtcgaagctctgcccatcgttctgaacatgttcgagaagaagcttagctcatacgcgcaaagccatctggaaaacacttcgatcaaagtacacctgagaaccgctgtcgccaaagttgaagagaagcagctgctggccaagaccaagcacgaggacggtaagataaccgaggaaactattccctacggtaccctgatttgggccacgggcaacaaggccagacccgtaatcaccgacctgttcaagaagattcccgagcaaaacagctccaagagaggcctggccgtgaacgacttcctgcaggtgaaaggcagcaacaacattttcgccattggcgacaacgcctttgccgggttgcctccaacagcccaggtggcgcaccaggaagccgagtatctggccaagaacttcgacaaaatggctcagatccccaatttccaaaagaacctatcttcacggaaggataagattgacctgctgttcgaggaaaacaactttaaacccttcaagtacaacgacttaggtgccttagcatacctgggcagcgaaagggccattgccaccataagatccggtaagcggaccttctacaccggcggaggcttaatgaccttctacctgtggcggatcctgtacttgtccatgatcctgagcgcccgcagcagattaaaggtcttcttcgactggattaaactggcctttttcaaaagagacttttttaagggcctgtga

SEQ ID NO: 30 - DNA, 1542 bp, Artificial Sequence
  source: /note="Description of Artificial Sequence: Synthetic polynucleotide"
atgctgagcaagaacttgtatagtaacaagcggctgctcaccagcaccaacaccctagtgcgcttcgccagcaccagatccaccggggtcgaaaactccggagcaggccccacaagcttcaagaccatgaaagtcattgacccccagcacagcgacaagccaaacgtgctgatcctgggctcggggtggggagccatctcgtttctgaagcacattgacaccaagaagtacaacgtctccatcatctctcccagaagctacttcctgttcacgcccttgttaccttctgcccctgtgggaacagtggacgagaagtcaatcatcgagcccatcgtgaactttgccctgaagaaaaagggcaacgtcacctactacgaggccgaagccacctctatcaatcccgacaggaacaccgtgaccatcaaatcactgagcgccgtgagccagctgtaccagcccgagaaccatctgggcctgcaccaagcagagcctgctgaaattaagtacgattatctgatcagcgccgtgggtgcggagcctaacacatttggtatccccggcgtgaccgactacggtcacttcctgaaagagatccccaacagcctggaaatcagacggaccttcgccgccaacctagaaaaggccaacctgttgcctaagggtgatcccgagagaagaaggctactgagcattgtcgtcgttggcggtgggcccacaggcgtggaggctgctggcgagctacaggactatgttcaccaggacctgcggaagttcctgcctgccctggccgaagaagtgcagattcacctggtcgaagccctgcccatcgtgttgaacatgttcgagaagaagcttagcagctacgcccaatcacatctggaaaacacctccatcaaagtgcacctgagaacggccgtggccaaggttgaagaaaagcaactgctggcaaagaccaagcacgaggacggcaagataaccgaagaaactatcccctacggcaccttgatttgggccacgggtaacaaggcaagaccggtaatcaccgacctgttcaagaaaatccccgagcagaacagcagcaagagaggcttggccgtgaacgacttcctgcaggtcaaaggcagcaacaacatcttcgccattggcgacaacgcatttgccggcttgccaccaacagcccaggtggcgcaccaggaagccgagtatctggccaagaacttcgacaaaatggcccaaatcccaaatttccaaaagaacctgtcttcacggaaggataagatcgatctcttgttcgaggaaaacaactttaaacccttcaagtacaacgatctgggcgccttagcatacctgggcagcgaaagagccattgccaccatccgtagcggcaagcggaccttctacaccggtggaggcctgatgaccttctacctgtggagaattttgtacctgtccatgattctaagcgcacgctcgagattaaaggtgtttttcgactggatcaaactggcattcttcaagagagacttctttaagggcctgtag

SEQ ID NO: 31 - DNA, 1542 bp, Artificial Sequence
  source: /note="Description of Artificial Sequence: Synthetic polynucleotide"
atgctgagcaagaacctgtacagtaacaagaggttgctgaccagcaccaatacgctagtgcgcttcgccagcaccagatccacaggcgtggaaaactccggagctggccccacaagcttcaagaccatgaaggtcattgacccccagcacagcgacaagcccaacgtgctgatcctgggctcggggtggggagccatctcgtttctgaagcacatcgacaccaagaagtacaacgtctccatcatctctcccagaagctacttcttatttacccccctgctgcccagcgcacctgttgggacagtggacgaaaagtccatcatcgagcccatcgtgaatttcgctctgaagaaaaagggcaacgtcacctactacgaggccgaggccacctctatcaaccccgacaggaataccgttaccatcaagagcttatctgccgtgagccagctgtaccaacccgaaaaccacctgggcctgcatcaagcagagcccgccgagattaagtacgactacctgatcagcgccgtaggtgccgaacccaacacctttggaattcccggggtcactgattacggccacttcctgaaagaaatccccaactctctggaaatacggcggacctttgccgccaatctagaaaaggccaacttactgcctaagggcgaccccgaacggagaaggctgctgtccatcgtcgtggttggtggagggcctacaggcgtggaagctgctggtgagctacaggattacgttcaccaggacctgcggaagttcctgcctgccttggccgaagaagtccagattcacctggtcgaagctctgcccatcgtgctgaacatgttcgagaaaaagctgagcagctacgcccagtcacacttagaaaacacttcgatcaaagtgcacctgagaacggccgtcgccaaagtggaagagaagcagctgttggccaagaccaaacacgaggacggcaaaattaccgaagaaaccattccatacggtactctgatttgggccaccggcaacaaggccagaccggtgatcaccgacctgttcaagaagattcccgagcagaactcgtccaagcggggcctggcagtgaacgacttcttgcaggtcaaaggcagcaacaacatcttcgccattggtgacaacgcctttgctggcctgcctcctaccgcccaggtggcccaccaggaagccgaatatctggccaagaattttgataagatggcccagatacccaatttccaaaagaacctatcctccagaaaggataagatcgacctgttgttcgaggagaacaactttaagcccttcaagtacaacgatctgggcgccttagcatacctgggcagcgaaagagccattgccaccatcagatccggcaagcggacattctacaccggtggtggcctgatgaccttctacctgtggcggatcttgtacctgtccatgatcctatctgcaagaagcagactgaaggtgttcttcgactggattaagttagccttcttcaaaagggacttcttcaaaggactgtga

SEQ ID NO: 32 - DNA, 1542 bp, Artificial Sequence
  source: /note="Description of Artificial Sequence: Synthetic polynucleotide"
atgctaagcaagaatttgtacagtaacaagaggctgctcaccagcaccaatacgctcgtgagattcgccagcaccagatccacaggggtcgaaaacagcggggctggccctaccagctttaagaccatgaaggtcattgacccccagcacagcgacaaacccaacgtgctgatcctgggttcgggctggggagccatcagctttttaaagcacattgacaccaagaagtacaacgtttccatcatcagccctagaagctatttcctgttcacgcccttgttacccagcgcacctgtggggaccgtagacgaaaagtccatcattgagcccatcgttaacttcgccctgaagaaaaagggcaacgtcacctactacgaggccgaggccaccagcatcaaccccgaccggaacaccgttaccatcaaaagcctgtctgccgtgtcccagctataccagcccgaaaaccatctgggcctgcaccaggcagaacccgctgaaattaagtacgactatctgatcagcgccgtaggtgccgagcccaacacctttggaatccctggcgtgactgactacggtcacttcctgaaagaaattcccaacagcttggaaataagaagaacctttgccgccaatctggagaaggccaacttattgcctaagggcgatcccgagagaagaaggctgctgagcattgtggtcgttggcggaggccccacaggtgtggaggctgctggcgaactgcaggactatgttcaccaggacctgcggaagtttctgcccgcattggccgaggaagtccagattcacttggtggaagctctgcccatcgtgttgaatatgttcgagaagaagcttagctcatacgcccaaagccacctggaaaacacctcgatcaaagtgcacctgagaaccgccgtggccaaggtggaagagaagcaactgctggccaagaccaagcacgaggacggtaaaataaccgaggaaactatcccctacggcactttgatttgggccacgggcaacaaggccagaccggtgatcaccgaccttttcaagaagatccccgagcagaactcgtccaagcggggactggccgtgaatgactttctgcaggtcaaaggcagcaacaacattttcgccatcggcgacaacgcctttgccggcctgcctcctacagcccaagtagcgcaccaggaagccgagtacctggccaagaacttcgacaaaatggcccagatccccaatttccaaaagaacctgtcttccagaaaggataagattgatctcctgttcgaggagaacaacttcaagcccttcaagtacaacgatctgggtgccctggcctacctgggaagcgaaagagccattgcaaccatccgtagcggtaagcggaccttttacaccggcggtggcctgatgaccttctacttatggagaatcctgtacctgagcatgattctaagcgccagatcgagactgaaggtgttcttcgactggattaagttagcctttttcaaaagggacttctttaagggcctgtag

SEQ ID NO: 33 - DNA, 1542 bp, Artificial Sequence
  source: /note="Description of Artificial Sequence: Synthetic polynucleotide"
atgctgagcaagaatctgtacagcaacaagaggttgctgacctcgaccaacaccctcgtccgcttcgcctccaccagatccacaggggtcgaaaacagcggagctggccccaccagctttaagaccatgaaggtcatcgacccccagcacagcgacaaacccaacgtgctgatcctgggttctggctggggagctatctcgtttttaaagcacatcgacaccaagaagtacaacgtcagcatcatctctcccagaagctacttcttattcacccctctgttacccagcgcacctgtgggaacagtagacgaaaagtccatcatcgagcccatcgtgaacttcgctctgaagaaaaaggggaacgtcacctactacgaggcagaggccaccagcatcaaccccgacaggaacaccgttaccatcaaaagcctgagcgccgtgtcccagctataccagcctgagaaccacctaggcctgcaccaggcagaacccgccgagattaagtacgattatctgatcagcgccgtgggcgccgagcctaacacatttggtattcctggggtcaccgactacggtcacttcctgaaggaaattcccaactctctggaaatcagacggactttcgccgccaacctagagaaggccaacttactgcctaagggtgaccccgagagaagaagactgctgtccattgtggtcgttggcggtggccccactggtgtggaagctgctggtgagctgcaggactacgtgcaccaggacctgcggaagttcctccctgccttggccgaagaagtccaaattcacctggtggaagccctgcccatcgtgctgaacatgttcgagaagaagctgtcaagctacgcgcagagccacttagaaaacacttccatcaaagtacacctgagaacggccgtggccaaggttgaagagaagcaactgctggccaagaccaagcacgaggacggcaagattaccgaggaaactatcccatacggtactctgatttgggccaccggtaacaaggcaagacccgtaatcactgaccttttcaagaagatccccgagcagaacagctccaagcggggcttggccgtgaacgacttcttgcaggtcaaaggcagcaacaacattttcgccatcggtgacaacgcatttgccggcttgccacctaccgcccaagtagcccaccaagaagccgaatatttggccaagaatttcgataagatggcccaaatacccaatttccagaagaacctgtcttcaagaaaggataaaatcgatctgctgttcgaggaaaacaacttcaagcctttcaagtacaacgacttaggcgccctggcatacctgggcagcgaaagagccattgccaccatcagatccggcaagagaaccttttacaccggcggaggcttaatgaccttctacttatggcggattttgtacctgagcatgattctgagcgcaagaagcagattaaaggtgttcttcgactggatcaagctggccttcttcaagagagacttcttcaaaggcctgtag

SEQ ID NO: 34 - DNA, 1542 bp, Artificial Sequence
  source: /note="Description of Artificial Sequence: Synthetic polynucleotide"
atgctatcgaagaacctgtacagtaacaagcggctgctgacctcgaccaacacgctagtgagattcgctagcaccagatccacaggcgtggaaaacagcggggctggccccaccagcttcaagaccatgaaggtcattgacccccagcacagcgacaagccaaacgtgctgatcctgggctctggctggggcgccatttcgtttctgaagcacatcgacaccaagaagtacaacgtttccatcatcagccccagaagctatttcttatttacgcccctgttacccagcgcaccagttggaacagtggacgagaagtcaatcattgagcccatcgtgaatttcgccctgaagaaaaaggggaacgttacctactacgaggcagaagccaccagcatcaaccccgaccggaataccgttaccatcaagagcctgtctgccgtttcccagctataccagcccgagaaccacctgggcctgcatcaggcagagcccgccgagattaagtacgactacctgatcagcgccgtaggcgcggaacctaacacctttggaatccccggggtcactgattacggccacttcctgaaagaaattcccaactctctggaaatccggagaacttttgccgccaacctggagaaggctaacctgctgcctaagggtgaccccgaaagaagaagactgctgagcatcgtcgtggtgggtggaggccctactggtgtagaggccgctggcgagctgcaggattatgtgcaccaggacctgagaaagtttctccccgccctggccgaggaagtccagattcacctggtggaagccctgcccatcgttttgaatatgttcgagaagaagcttagcagctacgcgcaaagccacctggaaaacacttccatcaaggtacacctgagaaccgccgtcgccaaggtggaagagaagcagttgctggccaagaccaagcacgaggacggcaagattaccgaggaaactatcccctacggtactctgatttgggccaccggcaacaaggcaagacccgtgatcactgacctgttcaagaagatccctgagcaaaacagcagcaagcggggattggcagtgaacgactttttgcaggtgaaaggcagcaacaacattttcgccatcggcgacaacgcctttgccggcttgccaccaaccgcccaggtagcgcaccaggaagccgagtatctggccaagaattttgacaagatggcccagatcccaaatttccaaaagaacctgtcctcccggaaggataagatcgacctgctgttcgaggaaaacaacttcaaacctttcaaatacaacgacttaggcgccctggcatacctgggctccgaaagagccattgccaccatccgtagcggcaagcggaccttttacaccggcggtggcctgatgaccttctacctgtggcggattctgtacttgagcatgatcctgagcgcccgctcgagattaaaggtgtttttcgactggattaagttagccttcttcaagagggacttttttaaaggcctgtag

SEQ ID NO: 35 - DNA, 1542 bp, Artificial Sequence
  source: /note="Description of Artificial Sequence: Synthetic polynucleotide"
atgctaagcaagaatttgtacagcaacaagcggctgctgaccagcaccaacacgctagtccgcttcgcctccaccagatccacaggcgtggaaaactccggggcaggtcccaccagcttcaagaccatgaaggtcatcgacccccagcacagcgacaagcccaacgtgctgatcctgggctcggggtggggcgctatctcgtttttaaagcacattgacaccaagaagtacaacgtctccatcatcagccccagaagctacttcctgttcacccctttgctgccttctgccccagtgggaacagtagacgaaaagtccatcatcgagcccatcgtgaatttcgccctgaagaaaaaggggaacgtcacctactatgaggccgaggccacctctatcaatcccgaccggaacaccgttaccatcaagagcttaagcgccgtgagccagctataccagcccgagaaccacctagggctgcaccaagccgaacccgctgaaattaagtacgactatttaatcagcgctgtgggcgcggaacccaacacatttggtatccccggggtcaccgattacggccatttcctgaaggagatccccaactctttggaaatccggcggactttcgccgccaacctggagaaggctaacctgctgccaaagggcgaccccgaacggagaaggctgctgagcatcgtggtggttggcggagggcccactggcgtggaagctgctggcgagctgcaggattatgtgcaccaggacctgcggaagttcctccctgcattggccgaggaagtccaaattcacctggtggaagccctgcccatcgtgttgaacatgttcgagaaaaagctttcaagctacgcccagagccacttagaaaacacttccatcaaagtacacctgagaaccgccgtggccaaagtggaagagaagcaactgttggcaaagaccaagcacgaggacggcaagataaccgaagaaaccattccatacggcactttgatttgggccaccggcaacaaggccagacccgtgatcaccgacctgttcaagaaaatccctgagcagaacagcagcaagcggggcttggccgtgaatgacttcctgcaggtgaaaggcagcaacaacatcttcgccatcggcgacaacgcctttgccggcttgccaccaacagcccaagtagcccaccaggaagccgaatacctggccaagaacttcgataaaatggcccaaatacccaatttccaaaagaacctgtcttcccggaaggataagattgatctgttgttcgaggaaaacaacttcaaacccttcaaatacaacgacttaggtgccctggcctacctgggctccgaaagagccattgccaccatcagaagcggcaagagaaccttttacaccggcggaggcttaatgaccttctacctgtggcggattctgtacctgagcatgatcctgtctgcaagaagcagattaaaggtcttcttcgactggatcaagctggcattcttcaaaagggacttctttaagggcctgtag

SEQ ID NO: 36 - DNA, 1542 bp, Artificial Sequence
  source: /note="Description of Artificial Sequence: Synthetic polynucleotide"
atgctatcgaagaacctgtatagcaacaagcggctgctcaccagcacgaataccctagtgagattcgcctccaccagatccaccggcgtggaaaacagcggggctggtcctaccagcttcaagaccatgaaagtcattgacccccagcacagcgacaaacccaacgtgctgatcctgggctctggctggggcgccatctcgtttttaaagcacattgacaccaagaagtacaacgtcagcatcatctctcccagaagctacttcctgttcacgcccctgctgccctctgccccagtgggaacagtagacgagaagtccatcatcgagcccatcgtgaattttgccctgaagaaaaaggggaacgtcacctactatgaggccgaggccaccagcatcaaccccgacaggaataccgtgaccatcaaatcattaagcgccgtgagccagctgtaccagcccgagaaccacctgggcctgcaccaggccgagcccgccgaaattaagtacgattatctgatcagtgccgtaggtgcggaacccaacacctttggaattcctggcgtgaccgactacggccacttcctgaaggaaatccccaacagcctggaaataagaagaaccttcgccgccaacctagagaaggccaacttattgccaaagggcgatcccgagcggagaaggctactgagcatcgtggtggtgggcggagggcccacaggtgtagaggccgctggcgagctgcaggactacgtgcaccaggacctgagaaagttcctccccgcattggccgaggaagtccaaattcacctggtcgaagctctgcccatcgtgttgaacatgttcgagaagaagctgtcaagctacgcgcagagccacctggaaaacacttcgatcaaggtacacctgagaacggccgtcgccaaggtggaagagaagcagctgctggcaaagaccaaacacgaggacggcaagattaccgaggaaaccattccctacggcactctgatttgggccacgggcaacaaggccagacccgtgatcaccgaccttttcaagaaaattcccgagcaaaactcgtccaagagaggactggcagtgaatgacttcttgcaggtcaaaggcagcaacaacatcttcgccatcggcgacaatgcatttgccgggctgcctcctacagcccaggtagcccaccaggaagccgaatacttggccaagaactttgataaaatggctcaaatcccaaatttccaaaagaacctatcctcacggaaggataagattgacctcctgttcgaggaaaacaacttcaaacccttcaagtacaacgacctgggcgccctggcatacctgggctccgaaagagccattgcaaccatccgttccggtaagcggacattttacaccggtggaggcttaatgaccttctacctgtggagaatcctgtacctgagcatgatcctgtctgcccgctcgagattaaaggtgttcttcgactggatcaagctggcattcttcaagagggacttttttaagggcctgtga

SEQ ID NO: 37 - DNA, 1542 bp, Artificial Sequence
  source: /note="Description of Artificial Sequence: Synthetic polynucleotide"
atgctgagcaagaatctgtacagcaacaagcggttgctgaccagcaccaatacgctcgtgcgcttcgctagcaccagatccaccggcgtcgaaaacagcggggctggtcctaccagcttcaagaccatgaaagtcattgaccctcagcacagcgacaagcccaacgtgctgatcctgggttcgggctggggagccattagctttctgaagcacatcgacaccaagaagtacaacgtttccatcatctctcccagaagctatttcctgttcacccccctgctgcctagcgcccctgtgggaaccgtggacgaaaagtccattatcgagcccatcgttaacttcgctctgaagaaaaagggcaacgttacctactatgaggcagaggccacctctatcaatcccgaccggaacaccgtgaccatcaagagcctgtctgccgtgagccagctgtaccaacccgaaaaccacctagggctgcaccaggccgagcccgctgagattaagtacgattacttaatcagcgccgtgggtgcggagcccaacacatttggaatccccggcgtgaccgattacggtcacttcctgaaggagatccccaactctctggaaatcagaagaacctttgccgccaacctagaaaaggccaacttactgcctaagggtgaccccgaacggagaagactgctgtccatcgtggtcgttggcggagggcctacaggcgtagaggccgctggcgaactgcaggattacgtgcaccaggacctgcggaagtttctccccgcactggccgaggaagtccagattcacctggtggaagccctgcccatcgttctgaacatgttcgagaagaagctgagcagctacgcgcaaagccacttagaaaacacttccatcaaagtacatctgagaaccgctgtggccaaggttgaagagaagcagctgttggccaagaccaagcacgaggacggcaagattaccgaggaaaccatcccatacggtaccctgatttgggccaccggcaacaaggccagacccgtaatcactgacctgttcaagaaaatccccgagcaaaactcgtccaagcggggattggccgtgaatgacttcctgcaggtcaaaggcagcaacaacatcttcgccatcggcgacaatgcctttgccggcttgcctcctaccgcccaagtagcgcaccaagaggccgaatatttggccaagaatttcgataaaatggcccaaataccaaatttccaaaagaatctatcttcacggaaggataagatcgatctcttgttcgaggagaacaacttcaagcccttcaagtacaacgatctgggcgccctggcatacctgggcagcgaaagagccattgcaaccatccgtagcggtaagcggacattctacaccggcggaggcctgatgaccttctacctgtggagaattttgtacttgtccatgatcctgtctgcacgcagcagactgaaggtgtttttcgactggatcaagctggccttcttcaaaagggacttcttcaagggactgtga

SEQ ID NO: 38 - DNA, 1542 bp, Artificial Sequence
  source: /note="Description of Artificial Sequence: Synthetic polynucleotide"
atgctgagcaagaatttgtacagtaacaagaggttgctcaccagcaccaataccctcgtccgcttcgccagcaccagatccacaggcgtcgaaaactccggagctggccctaccagcttcaagaccatgaaagtcattgaccctcagcacagcgacaaaccaaacgtgctgatcctgggttctggctggggcgccatcagctttctgaagcacattgacaccaagaagtacaacgttagcatcatcagccccagaagctatttcctgtttacgcctctgttacccagcgccccagttggaaccgtggacgagaagtccattatcgagcccatcgttaactttgccctcaagaaaaagggcaacgtcacctactacgaggccgaggccaccagcatcaatcccgaccggaataccgtgaccatcaaaagcctgagcgccgtgtcccagctataccaacccgaaaaccacctagggctgcaccaggccgagcctgccgagattaagtacgattacctgatcagcgctgtgggcgcggaacctaacacatttggaatccctggcgtgactgactacggccatttcctgaaagagattcccaactctttggaaatccggcggacttttgccgccaacctggagaaggccaacctgttgccaaagggcgaccccgagcggagaaggctgctgtccattgtggtggtgggcggaggccccactggcgtggaagccgctggcgagctacaggactatgtgcaccaggacctgcggaagttcctccctgccttggccgaggaagtccaaattcacctggtggaagccctgcccatcgttctgaacatgtttgagaagaagctttcaagctacgcccagtcacacttagaaaacacttccatcaaagtgcacctgagaaccgccgtcgccaaggtggaagagaagcagctgttggccaagaccaagcacgaggacggcaaaattaccgaagaaactattccatacggtaccttgatttgggccacgggtaacaaggcaagacccgtgatcactgaccttttcaagaagatccccgagcaaaacagctccaagagaggcctggccgtgaacgactttctgcaggtgaaaggcagcaacaacatcttcgccatcggcgacaatgcctttgctgggttgcctcctacagcccaagtagcccaccaggaagccgagtatttggccaagaacttcgataagatggcccaaatccccaatttccaaaagaatctgtcctcccggaaggataagattgacctcctgttcgaggaaaacaacttcaagcctttcaaatacaacgacttaggcgccctggcatacctgggaagcgaaagggccattgcaaccatccgtagcggcaagcggacattctacaccggcggtggcctgatgaccttctacttatggcggatcctgtacctgagcatgatcctgtctgcacgctcgagattaaaggtcttcttcgactggatcaagctggccttcttcaaaagggacttcttcaagggcttatag

SEQ ID NO: 39 - DNA, 1542 bp, Artificial Sequence
  source: /note="Description of Artificial Sequence: Synthetic polynucleotide"
atgctgtcgaagaatctgtacagcaacaagcggctgctgaccagcaccaacaccctcgtccgcttcgcctccaccagatccaccggcgtggaaaacagcggggctggccctaccagctttaagaccatgaaagtcattgacccccagcacagcgacaagccaaacgtgctgatactgggttctgggtggggagccatcagctttctgaagcacattgacaccaagaagtacaacgttagcatcatctctcccagaagctacttcttatttacccccttgctgccctctgcccctgtggggaccgtggacgagaagtccattatcgagcccatcgtgaatttcgctctgaagaaaaaggggaacgtcacctactatgaggcagaagccaccagcatcaaccccgacaggaacaccgtgaccataaagagcctgtctgccgtgtcccagctgtaccagcccgagaaccacctggggctgcatcaggcagaacccgccgaaattaagtacgactacttaatcagtgccgtgggcgccgaacccaacacctttggaatccctggggtcaccgactacggccatttcctgaaagagatccccaactctctggaaatcagaagaactttcgccgccaacctagaaaaggctaacttattgcctaagggtgatcccgaaagaagaagactgctgtccatcgtggtcgtgggcggagggcccacaggcgtggaagctgctggcgagctgcaggactatgtgcaccaggacctgcggaagttcctgcccgcattggccgaggaagtccaaattcacttggtcgaagctctgcccatcgttctgaacatgttcgagaaaaagctttcaagctacgcccagtcacacttagaaaacacttccatcaaagtgcacctgagaacggccgtggccaaagtggaagagaagcaattgttggccaagaccaaacacgaagacggcaaaattaccgaagaaaccatcccatacggcaccctgatttgggccaccggcaacaaggccagacccgtgatcactgacctgttcaagaagatccctgagcaaaactcgagcaagcggggactggccgtgaatgactttttgcaggtcaaaggcagcaacaacattttcgccattggcgacaacgcctttgccggcctgcctcctacagcccaggtagcccaccaggaggccgagtacttggccaagaacttcgataaaatggcccagatacccaatttccaaaagaatctgtcctcccggaaggataaaattgatctgttgttcgaggaaaacaacttcaagcctttcaagtacaacgatttaggcgccctggcatacctgggctccgaaagggccattgcaaccataagatccggtaagcggaccttctacaccggcggaggcctgatgaccttctacctgtggagaatcttgtacctgagcatgatcctgtctgcaagaagcagactgaaggtgttcttcgactggattaaactggccttcttcaaaagggacttctttaaaggcttatag

SEQ ID NO: 40 - DNA, 1542 bp, Artificial Sequence
  source: /note="Description of Artificial Sequence: Synthetic polynucleotide"
atgctatcgaagaacttgtacagtaacaagcggctgctgacctcgaccaacaccctcgtccgcttcgccagcaccagatccacaggggtggaaaacagcggagctggccctacatctttcaagaccatgaaagtcatcgacccccagcacagcgacaagccaaacgtgctgatactgggttctggctggggcgctatctcgtttctgaagcacatcgacaccaagaagtacaacgttagcatcatcagccccagaagctacttcctgttcacgcctttgctgcccagcgccccagtggggacagtggacgagaagtccattattgagcccatcgttaactttgctctcaagaaaaagggcaacgtcacctactacgaggccgaggccacctctatcaatcccgaccggaacaccgttaccatcaagtcactgtctgccgtttcccagctgtaccagcctgagaaccatctggggctgcaccaagccgaacctgccgaaattaagtacgactacctgatcagcgctgtgggtgccgagcccaacacatttggtatccccggggtgaccgactacggtcacttcctgaaggaaatccccaacagcctggaaatccggcggacctttgccgccaatctggaaaaggccaacctgctgcctaagggtgaccccgagcggagaagactgctgagcatcgtggtcgtgggcggtggccctacaggtgtagaagctgctggtgagctacaggactacgtgcaccaggacctgcggaagttcctccctgccttggccgaggaagtgcagattcacctggtggaagctctgcccatcgttctgaacatgttcgagaagaagctgtcaagctacgcccagagccacctggaaaacacctccatcaaagtgcacctgagaacggccgtggccaaggtggaagaaaagcagttgctggccaagaccaagcacgaagacggtaagattaccgaggaaactattccctacggtactttgatttgggccacgggcaacaaggccagaccggtaatcactgaccttttcaagaaaattcccgagcagaacagcagcaagcggggattggccgtgaatgactttctgcaggtgaaaggcagcaacaacattttcgccatcggtgacaacgcctttgctggcctgccaccaacagcccaggtagcgcaccaggaagccgaatacttggccaagaattttgacaaaatggcccagatacccaatttccagaagaacctatcctcccggaaggataaaatcgatctgctgttcgaggaaaacaacttcaagcccttcaaatacaacgacctgggtgccctggcctacctgggcagcgaaagagccattgccaccatccgttccggtaagcggacattttacaccggtggaggcctgatgaccttctacctgtggagaattttgtacttgtccatgattctgtctgcccgcagcagactgaaggtgtttttcgactggattaagttagcctttttcaagagggacttcttcaagggattatga

SEQ ID NO: 41 - DNA, 1542 bp, Artificial Sequence
  source: /note="Description of Artificial Sequence: Synthetic polynucleotide"
atgctgtcgaagaatttgtacagcaacaagaggttgctcacctcgaccaataccctcgtgcgcttcgccagcaccagatccaccggggtcgaaaactccggggctggtcctacctctttcaagaccatgaaagtcatcgacccccagcacagcgacaagccaaacgtgctgatcctgggctcggggtggggagctatcagctttctgaagcacattgacaccaagaagtacaacgtcagcatcatcagccccagaagctacttcctgttcacccccctgctgcctagcgccccagtggggacagtggacgagaagtcaattatcgagcccatcgtgaatttcgctctgaagaaaaagggcaacgttacctactacgaggcagaagccaccagcatcaatcccgacaggaacaccgttaccatcaagtcattatctgccgtttcccagctgtaccaacccgaaaaccacctgggcctgcaccaggccgagcccgccgagattaagtacgattacttaatcagcgccgtgggcgcggaacccaacacctttggtatccccggcgtcaccgactacggtcacttcctgaaagaaattcccaacagcctggaaatccggagaacttttgccgccaacctggaaaaggccaacttactgcctaagggcgatcccgagcggagaagactactgtccatcgtggtcgtgggcggaggccctacaggcgtagaagccgctggcgaactacaggactatgttcaccaggacctgcggaagtttctgcccgcattggccgaagaagtgcaaattcacttggtcgaagccctgcccatcgtgctgaacatgttcgagaagaagctgtcaagctacgcccagtcacacctggaaaacacttcgatcaaggtgcacctgagaacggccgtcgccaaggtggaagagaagcaactgttggcaaagaccaaacacgaagacggcaagataaccgaagaaaccattccctacggcaccctgatttgggccacgggtaacaaggccagaccggtgatcactgacctgttcaagaagatccccgagcagaactcgtccaagcggggcctggcagtgaacgactttctgcaggtgaaaggcagcaacaacattttcgccatcggtgacaacgcatttgccggcctgcctccaacagcccaagtggcgcaccaagaagccgaatacttggccaagaatttcgacaaaatggcccaaatcccaaatttccagaagaacctgtcctcccggaaggataagatcgatctgttgttcgaggaaaacaactttaaacccttcaaatacaacgatctgggcgccctggcctacctgggaagcgaaagggccattgccaccataagatccggtaagcggacattttacaccggcggaggcctgatgaccttctacctgtggcggatcctgtacctgagcatgatcctgagcgcacgcagcagattaaaggtgttcttcgactggattaaactggcctttttcaaaagggacttcttcaaaggcttatag

SEQ ID NO: 42 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctagtgcgcttcgccagcaccagatccaccggcgtcgaaaactccggggctggccccaccagcttcaagaccatgaaggtcatcgaccctcagcacagcgacaagcccaacgtgctgatcctgggctctgggtggggcgctatcagctttctgaagcacatcgacaccaagaagtacaacgtctccatcatcagccccagaagctacttcctgttcacccccctgctgcccagcgcccctgtgggaaccgtggacgaaaagtcaatcatcgagcccatcgtgaatttcgccctgaagaaaaagggcaacgtcacctactacgaggccgaggccaccagcatcaaccccgaccggaacaccgtgaccatcaagagcctgagcgccgtgtcccagctgtaccaacccgagaaccatctgggcctgcaccaggccgagcccgccgagattaagtacgactacctgatcagtgccgtgggcgccgagcccaacacctttggaatccccggcgtgaccgactacggccacttcctgaaagagatccccaacagcctggaaatcagacggaccttcgccgccaacctggaaaaggctaacctgctgcctaagggcgaccccgagagaagaaggctactgagcatcgtggtcgtgggcggaggccccacaggcgtggaagctgctggcgagctacaggactacgtgcaccaggacctgcggaagttcctccccgccctggccgaggaagtgcagattcacctggtggaagctctgcccatcgtgctgaacatgttcgagaagaagcttagcagctacgcccagagccacttagaaaacacctccatcaaggtacacctgagaacggccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaatgcctttgccggcctgcctcctacagcccaggtggcccaccaggaagccgagtacctggccaagaactttgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgcaaccatcagaagcggcaagcggaccttctacaccggcggaggcctgatgaccttctacctgtggcggatcttgtacctgagcatgatcctgtctgcccgcagcagactgaaggtgttcttcgactggatcaagctggccttcttcaagagagacttcttcaagggcctgtga

SEQ ID NO: 43 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccacaggcgtcgaaaacagcggggctggccccaccagctttaagaccatgaaggtcatcgacccccagcacagcgacaagcccaacgtgctgatcctgggctctggctggggcgccatcagctttctgaagcacatcgacaccaagaagtacaacgttagcatcatcagccccagaagctacttcctgttcacccccctgctgcccagcgcccctgtgggaaccgtggacgagaagtcaatcatcgagcccatcgtgaacttcgctctgaagaaaaagggcaacgtcacctactacgaggccgaggccaccagcatcaaccccgaccggaacaccgtgaccatcaagagcctgagcgccgtttcccagctgtaccaacccgagaaccacctgggcctgcaccaggccgaacccgccgagattaagtacgactacctgatcagcgccgtgggtgccgagcccaacacctttggaatccccggcgtcaccgactacggccacttcctgaaagagatccccaacagcctggaaatccggcggaccttcgccgccaacctagaaaaggccaacctgttgccaaagggcgaccccgagcggagaaggctgctgagcatcgtggtggtgggcggagggcccacaggcgtggaagctgctggcgaactgcaggactacgtgcaccaggacctgcggaagttcctccccgcactggccgaggaagtgcagattcacctggtggaagccctgcccatcgtgctgaacatgttcgagaagaagctgagctcatacgcccagagccacctggaaaacacctccatcaaggtgcacctgagaaccgccgtggccaaggtggaagagaagcagctgctggccaagaccaagcacgaggacggtaagattaccgaggaaaccatcccctacggcactctgatttgggccaccggcaacaaggccagacccgtgatcaccgacctgttcaagaagatccccgagcagaacagcagcaagcggggcttggccgtgaatgacttcctgcaggtcaaaggcagcaacaacatcttcgccatcggtgacaacgcctttgccggcctgcctcctacagcccaggtggcccaccaggaagccgagtacctggccaagaacttcgacaagatggcccagatccccaatttccagaagaacctgtcctcccggaaggataagatcgacctgttgttcgaggaaaacaacttcaagcccttcaagtacaacgacttaggtgccctggcctacctgggcagcgaaagggccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggcctttttcaagagggacttcttcaagggcctgtga

SEQ ID NO: 44 - DNA, 1542 bp, Artificial Sequence
  source: /note="Description of Artificial Sequence: Synthetic polynucleotide"
atgctgagcaagaacctgtacagcaacaagcggctgctgacctcgaccaacaccctagtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtagacgagaagtccatcatcgagcccatcgtgaacttcgccctgaagaaaaagggcaacgtcacctactacgaggccgaggccaccagcatcaatcccgaccggaacaccgtgaccatcaagagcctgagcgccgtgtcccagctgtaccaacctgagaaccacctaggcctgcaccaggccgagcccgccgaaattaagtacgattacctgatcagcgccgtgggcgccgagcccaacacctttggaatccccggggtgaccgactacggccacttcctgaaagagatccccaactctctggaaatacggcggaccttcgccgccaacctggaaaaggctaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtcgaagccctgcccatcgtgctgaatatgttcgagaaaaagctgagcagctacgcccagagccacctggaaaacacctccatcaaggtacacctgagaaccgccgtggccaaggtggaagagaagcagctgctggccaagaccaagcacgaggacggcaagataaccgaggaaaccatcccctacggcaccctgatttgggccaccggcaacaaggccagacccgtgatcaccgacctgttcaagaaaatccccgagcagaacagctccaagcggggcctggccgtgaacgacttcctgcaggtcaaaggcagcaacaacatcttcgccatcggcgacaacgcatttgccgggttgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaaatacaacgatctgggcgccctggcctacctgggcagcgaaagagccattgccaccatccgtagcggcaagcggaccttctacaccggcggtggcctgatgaccttctacctgtggcggatcctgtacctgagcatgatcctgagcgcccgcagcagactgaaggtgttcttcgactggatcaagctggcattcttcaagagggactttttcaagggcctgtga

SEQ ID NO: 45 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggagctggccccaccagcttcaagaccatgaaggtcatcgacccccagcacagcgacaagccaaacgtgctgatcctgggctctggctggggcgccatcagctttctgaagcacatcgacaccaagaagtacaacgtctccatcatcagccccagaagctacttcctgttcacccccctgttacccagcgcccctgtgggaacagtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtttcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaatctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccttggccgaggaagtgcagattcacctggtggaagctctgcccatcgtgctgaacatgttcgagaagaagctgagcagctacgcccagagccacctggaaaacacctccatcaaggtgcacctgagaaccgccgtcgccaaggtggaagagaagcagctgctggccaagaccaagcacgaggacggcaagataaccgaggaaaccattccctacggcaccttgatttgggccaccggcaacaaggccagacccgtgatcactgacctgttcaagaagatccccgagcagaacagcagcaagagaggcctggccgtgaacgacttcctgcaggtcaaaggcagcaacaacatcttcgccattggcgacaacgcctttgccggcctgcctcctacagcccaggtggcccaccaggaggccgagtacctggccaagaacttcgataagatggcccaaatacccaatttccagaagaacctgtcctcccggaaggataagatcgacctgctgttcgaggaaaacaacttcaaacccttcaagtacaacgatctgggcgccctggcatacctgggcagcgaaagagccattgccaccataagaagcggtaagcggaccttctacaccggtggtggcctgatgaccttctacctgtggcggatcctgtacctgtccatgatcctgagcgcccgcagcagactgaaggtgttcttcgactggatcaaactggccttcttcaagagggacttcttcaagggcctgtga

SEQ ID NO: 46 - DNA, 1542 bp, Artificial Sequence
  source: /note="Description of Artificial Sequence: Synthetic polynucleotide"
atgctgtcgaagaatctgtacagcaacaagcggctgctgaccagcaccaacaccctcgtgcgcttcgccagcaccagatccaccggcgtcgaaaacagcggggctggccctaccagcttcaagaccatgaaagtcatcgacccccagcacagcgacaagcccaacgtgctgatcctgggctctggctggggcgctatcagctttctgaagcacatcgacaccaagaagtacaacgttagcatcatcagccccagaagctacttcctgttcacccccctgctgccctctgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccaacccgagaaccatctgggcctgcaccaggccgagcccgccgagattaagtacgactacctgatcagcgccgtgggcgccgagcccaacacctttggaatccccggcgtgaccgactacggccacttcctgaaagagattcccaacagcctggaaatccggcggaccttcgccgccaacctggaaaaggctaacctgctgcctaagggcgaccccgagcggagaaggctgctgagcatcgtcgtcgtgggcggaggccccacaggcgtggaagctgctggcgagctacaggactacgtgcaccaggacctgagaaagttcctccccgccctggccgaggaagtgcagattcacctggtggaagccctgcccatcgtgctgaacatgttcgagaagaagctgagcagctacgcccagagccacctggaaaacacctccatcaaggtgcacctgagaaccgctgtggccaaggtggaagagaagcagctgctggccaagaccaagcacgaggacggcaagattaccgaggaaaccatcccctacggcaccctgatttgggccaccggcaacaaggccagacccgtgatcactgacctgttcaagaagatccccgagcagaacagcagcaagagaggcctggccgtgaacgacttcctgcaggtgaaaggcagcaacaacatcttcgccattggtgacaacgcctttgccggcctgcctcctacagcccaggtggcccaccaggaagccgagtacctggccaagaacttcgacaagatggcccaaatccccaatttccagaagaacctatcctccagaaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggagaatcttgtacctgagcatgatcctgagcgcccgcagcagactgaaggtgttcttcgactggatcaaactggcctttttcaaaagggacttcttcaagggcctgtga

SEQ ID NO: 47 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccacaggcgtcgaaaacagcggggctggccccaccagcttcaagaccatgaaggtcatcgaccctcagcacagcgacaagcccaacgtgctgatcctgggctctggctggggcgctatcagctttctgaagcacatcgacaccaagaagtacaacgtcagcatcatcagccccagaagctacttcttatttacccccctgttacccagcgcccctgtgggaaccgtggacgagaagtccatcatcgagcccatcgttaacttcgccctgaagaaaaagggcaacgtcacctactacgaggccgaagccacctctatcaaccccgaccggaacaccgttaccatcaagagcctgagcgccgtgtcccagctgtaccagcccgagaaccacctgggcctgcaccaagccgagcccgctgagattaagtacgactacctgatcagcgccgtgggcgccgagcccaacacctttggaatccccggcgtgactgactacggccacttcctgaaagagatccccaacagcctggaaatccggcggactttcgccgccaatctggagaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagcttagcagctacgcccagagccacttagaaaacacctccatcaaggtgcacctgagaaccgccgtggccaaggtggaagagaagcagctgctggcaaagaccaagcacgaggacggcaaaataaccgaggaaaccatcccctacggcactctgatttgggccaccggcaacaaggccagacccgtgatcaccgacctgttcaagaagattcctgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaatttcgacaagatggcccagatccccaatttccagaagaacctgtcctcccggaaggataagatcgacctcctgttcgaggagaacaacttcaagcccttcaagtacaacgacttaggcgccctggcctacctgggcagcgaaagagccattgccaccatcagaagcggcaagagaaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 48 - DNA, 1542 bp, Artificial Sequence
  source: /note="Description of Artificial Sequence: Synthetic polynucleotide"
atgctaagcaagaacctgtatagtaacaagcggctgctgaccagcaccaacaccctcgtccgcttcgccagcaccagatccaccggcgtcgaaaactccggggctggccccaccagcttcaagaccatgaaggtcatcgacccccagcacagcgacaagcccaacgtgctgatcctgggctctggctggggcgccatcagctttctgaagcacatcgacaccaagaagtacaacgtctccatcatcagccccagaagctacttcctgttcacccccctgctgcccagcgcccctgtgggaaccgtggacgagaagtccatcatcgagcccatcgtgaattttgccctgaagaaaaagggcaacgtcacctactacgaggccgaggccaccagcatcaatcccgaccggaacaccgtgaccataaaaagcttaagcgccgtgtcccagctgtaccagcccgagaaccatctgggcctgcaccaggccgagcctgccgagattaagtacgactacctgatcagcgccgtgggcgccgagcccaacacctttggaatccccggcgtgaccgactacggccacttcctgaaagaaatccccaacagcctggaaatccggcggaccttcgccgccaatctggaaaaggccaacctgctgcctaagggcgaccccgagcggagaaggctgctgagcatcgtcgtcgtgggcggaggccccacaggtgtggaagctgctggcgagctgcaggactacgtgcaccaggacctgcggaagttcctgcccgccctggccgaggaagtgcagattcacctggtggaagccctgcccatcgtgctgaacatgttcgagaagaagctgtcaagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggtaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccaaaagaacctgtcctcccggaaggataagattgacctgttgttcgaggaaaacaacttcaaacccttcaagtacaacgacctgggcgccctggcctacctgggcagcgaaagagccattgccaccatcagaagcggcaagcggaccttttacaccggcggtggcctgatgaccttctacctgtggcggatcctgtacctgagcatgatcctgagcgcacgctcgagactgaaggtcttcttcgactggatcaagctggccttcttcaagagggacttcttcaagggcctgtga

SEQ ID NO: 49 - DNA, 1542 bp, Artificial Sequence
  source: /note="Description of Artificial Sequence: Synthetic polynucleotide"
atgctgagcaagaacctgtatagcaacaagcggctgctgaccagcaccaacaccctcgtgcgcttcgccagcaccagatccaccggcgtcgaaaacagcggggcaggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctatttcctgttcacccccctgctgccctctgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgtctgccgtgtcccagctataccagcccgagaaccacctagggctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgaacggagaaggctgctgagcatcgtggtcgtgggcggaggccccacaggcgtggaagctgctggcgagctgcaggactacgttcaccaggacctgagaaagttcctgcccgccctggccgaggaagtgcagattcacctggtggaagccctgcccatcgtgctgaatatgttcgagaagaagctgagcagctacgcccagagccacctggaaaacacctccatcaaggtgcacctgagaacggccgtggccaaagtggaagagaagcagctgctggccaagaccaagcacgaagacggcaagattaccgaggaaaccatcccctacggtaccctgatttgggccaccggcaacaaggccagacccgtgatcaccgacctgttcaagaaaatccccgagcagaacagcagcaagcggggcctggccgtgaatgacttcctgcaggtcaaaggcagcaacaacatcttcgccatcggcgacaacgcatttgccggcttgcctcctacagcccaggtggcccaccaggaagccgagtacttggccaagaacttcgacaagatggctcagatacccaatttccaaaagaacctgtcttcccggaaggataagatcgatctgctgttcgaggaaaacaacttcaagcccttcaagtacaacgatctgggcgccctggcctacctgggcagcgaaagagccattgccaccatcagaagcggcaagcggaccttttacaccggcggaggcctgatgaccttctacctgtggcggatcctgtacctgagcatgatcctgagcgcccgcagcagactgaaggtgttcttcgactggattaagctggccttcttcaagagggacttcttcaagggcctgtga

SEQ ID NO: 50 - DNA, 1542 bp, Artificial Sequence
  source: /note="Description of Artificial Sequence: Synthetic polynucleotide"
atgctgagcaagaacctgtatagcaacaagcggctgctgaccagcaccaataccctcgtgcgcttcgccagcaccagatccaccggcgtcgaaaacagcggggctggccccacctctttcaagaccatgaaggtcatcgacccccagcacagcgacaagccaaacgtgctgatcctgggctctggctggggcgccatcagctttctgaagcacatcgacaccaagaagtacaacgtcagcatcatcagccccagaagctacttcctgttcacccccttgctgcccagcgcccctgtgggaaccgtggacgaaaagtccatcattgagcccatcgtgaacttcgccctgaagaaaaagggcaacgttacctactacgaggccgaagccaccagcatcaaccccgaccggaacaccgtgaccatcaagtcactgagcgccgtgagccagctgtaccagcctgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcattgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaatatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccattccctacggcaccctgatttgggccacgggcaacaaggccagacccgtgatcaccgacctgttcaagaagatccccgagcaaaacagcagcaagcggggcctggccgtgaacgacttcctgcaggtgaaaggcagcaacaacatcttcgccatcggcgacaacgcctttgccggcctgcctcctacagcccaagtggcccaccaggaagccgagtacttggccaagaacttcgacaagatggcccagatccccaatttccagaagaacctgtcctcccggaaggataagatcgacctgctgttcgaggaaaacaacttcaagcccttcaagtacaacgacctgggcgccttagcctacctgggctccgaaagagccattgccaccataagaagcggcaagcggaccttttacaccggcggaggcctgatgaccttctacctgtggcggatcctgtacctgagcatgattctgtctgcccgctcgagactgaaggtgtttttcgactggatcaaactggccttcttcaagagggacttcttcaagggcctgtga

SEQ ID NO: 51 - DNA, 1542 bp, Artificial Sequence
  source: /note="Description of Artificial Sequence: Synthetic polynucleotide"
atgctgagcaagaacctgtacagcaacaagaggctgctcaccagcaccaacaccctcgtccgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcttattcacccccctgctgcccagcgcccctgtggggaccgtggacgagaagtccatcatcgagcccatcgtgaacttcgctctgaagaaaaaggggaacgtcacctactacgaggccgaggccaccagcatcaaccccgaccggaacaccgtgaccatcaagagcctgagcgccgtgtcccagctgtaccagcccgagaaccacctgggcctgcaccaggcagagcccgccgagattaagtacgactatctgatcagcgccgtgggcgccgagcccaacacctttggaatccctggcgtgaccgactacggccacttcctgaaagagatccccaacagcctggaaatacggcggaccttcgccgccaacctggaaaaggccaacttactgcctaagggcgaccccgagcggagaaggctgctgagcatcgtggtcgtgggcggaggccccacaggtgtggaagctgctggtgaactgcaggactacgtgcaccaggacctgcggaagttcctgcccgccctggccgaggaagtgcagattcacttggtggaagccctgcccatcgtgctgaacatgttcgagaagaagctgagcagctacgcccagagccacctggaaaacacctccatcaaggtgcacctgagaaccgctgtggccaaggtggaagagaagcagttgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtgaaaggcagcaacaacatcttcgccatcggcgacaacgcctttgccggcctgcctcctacagcccaggtagcccaccaggaagccgagtacctggccaagaacttcgacaagatggcccagatccccaatttccagaagaatctgtcctcccggaaggataagatcgatctgctgttcgaggaaaacaactttaagcccttcaagtacaacgatctgggcgccctggcctacctgggcagcgaaagggccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaaaagggactttttcaaaggactgtga

SEQ ID NO: 52 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccacaagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgtttacccccctgctgcccagcgcccctgtgggaaccgtggacgagaagtccatcatcgagcccatcgtgaacttcgctctgaagaaaaaggggaacgtcacctactacgaggcagaggccaccagcatcaaccccgaccggaataccgtgaccatcaagagcctgagcgccgtttcccagctgtaccagcccgagaaccacctgggcctgcaccaggccgagcccgccgagattaagtacgactacctgatcagcgccgtgggcgcggaacctaacacctttggaatccccggcgtgaccgactacggccacttcctgaaagagatccccaactctctggaaatacggcggaccttcgccgccaacctggaaaaggccaacctgctgcctaagggcgaccccgagcggagaaggctgctgagcatcgtggtcgtgggcggtggccccacaggcgtggaagccgctggcgagctgcaggactacgtgcaccaggacctgcggaagttcctgcccgcactggccgaggaagtgcagattcacctggtggaagccctgcccatcgtgctgaacatgttcgagaagaagctgagcagctacgcccagagccacctggaaaacacctcgatcaaagtgcacctgagaaccgccgtcgccaaggtggaagagaagcagttgctggccaagaccaagcacgaggacggcaagattaccgaggaaactatcccctacggtaccctgatttgggccaccggcaacaaggccagacccgtgatcaccgacctgttcaagaaaatccccgagcagaacagcagcaagcggggactggccgtgaacgacttcctgcaggtcaaaggcagcaacaacatcttcgccatcggcgacaacgcctttgccggcttgcctcctacagcccaggtggcccaccaggaagccgagtacctggccaagaacttcgacaagatggcccagatacccaatttccagaagaacctgtcttcccggaaggataagatcgacctgctgttcgaggaaaacaacttcaagcctttcaagtacaacgacctgggcgccctggcctacctgggcagcgaaagagccattgccaccataagaagcggcaagcggaccttctacaccggcggaggcctgatgaccttctacctgtggcggatcctgtacctgtccatgatcctgagcgcccgcagcagactgaaggtgttcttcgactggatcaagctggccttcttcaagagggacttcttcaagggcctgtga

SEQ ID NO: 53 - DNA, 1542 bp, Artificial Sequence
  source: /note="Description of Artificial Sequence: Synthetic polynucleotide"
atgctgagcaagaacctgtacagcaacaagcggttgctgaccagcaccaacaccctcgtccgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcttattcacccccctgctgcccagcgcccctgtggggaccgtggacgagaagtccatcatcgagcccatcgtgaacttcgccctgaagaaaaagggcaacgtcacctactacgaggccgaggccaccagcatcaatcccgaccggaacaccgtgaccatcaagagcttaagcgccgtgtcccagctgtaccagcccgagaaccacctgggcctgcaccaggcagaacccgccgagattaagtacgactacctgatcagcgccgtgggcgccgagcctaacacctttggaatccccggcgtgaccgactacggtcacttcctgaaagagatccccaacagcctggaaatccggcggaccttcgccgccaacctggaaaaggccaacctgctgcctaagggcgaccccgaacggagaaggctgctgagcatcgtggtcgttggcggaggccccacaggtgtagaagctgctggcgagctgcaggactacgtgcaccaggacctgcggaagttcctgcctgccctggccgaggaagtccagattcacctggtggaagccctgcccatcgtgctgaacatgttcgagaagaagctgagcagctacgcccagagccatctggaaaacacctccatcaaggtgcacctgagaaccgccgtggccaaagtggaagagaagcagctgctggccaagaccaagcacgaggacggcaagattaccgaggaaaccatcccctacggtaccctgatttgggccaccggcaacaaggccagacccgtgatcaccgaccttttcaagaagattcccgagcagaacagctccaagcggggcctggccgtgaacgacttcctgcaggtcaaaggcagcaacaacatcttcgccatcggcgacaacgcatttgccggcctgcctcctacagcccaggtggcgcaccaggaagccgagtacctggccaagaacttcgacaagatggcccagatccccaatttccagaagaacctgtcctcccggaaggataagatcgacctcctgttcgaggaaaacaacttcaagcctttcaagtacaacgacctgggcgccctggcctacctgggcagcgaaagagccattgcaaccataagaagcggcaagcggaccttctacaccggcggaggcctgatgaccttctacctgtggcggatcctgtacctgagcatgatcctgagcgcccgcagcagactgaaggtgttcttcgactggatcaagctggcattcttcaagagggacttcttcaagggcctgtga

SEQ ID NO: 54 - DNA, 1542 bp, Artificial Sequence
  source: /note="Description of Artificial Sequence: Synthetic polynucleotide"
atgctgagcaagaatctgtacagcaacaagcggctgctgaccagcaccaacaccctcgtgcgcttcgccagcaccagatccaccggcgtcgaaaacagcggggctggccccaccagcttcaagaccatgaaagtcatcgacccccagcacagcgacaagcccaacgtgctgatcctgggctcgggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaactttgccctgaagaaaaagggcaacgtcacctactacgaggccgaggccacctctatcaaccccgaccggaacaccgtgaccatcaagagcctgagcgccgtgtcccagctgtaccagcccgagaaccacctaggcctgcaccaggccgagcccgccgagattaagtacgactacctgatcagcgccgtgggcgccgagcccaacacctttggaatccccggcgtgaccgactacggccacttcctgaaagagatccccaacagcttggaaatacggcggaccttcgccgccaacctggaaaaggccaacctgctgcctaagggtgaccccgagcggagaaggctgctgagcatcgtggtcgtgggcggaggccccacaggcgtggaagctgctggcgaactgcaggactacgtgcaccaggacctgcggaagttcctgcccgccctggccgaggaagtgcagattcacctggtggaagccctgcccatcgtgctgaacatgttcgagaagaagctgagctcatacgcccagagccacctggaaaacacctccatcaaggtgcacctgagaaccgccgtggccaaggtggaagagaagcaactgctggccaagaccaaacacgaggacggcaagattaccgaggaaaccatcccctacggcaccctgatttgggccaccggcaacaaggccagacccgtgatcaccgaccttttcaagaagatccccgagcagaacagctccaagcggggcctggccgtgaacgacttcctgcaggtcaaaggcagcaacaacatcttcgccatcggcgacaatgcctttgccggcctgcctccaacagcccaggtagcccaccaggaggccgagtacttggccaagaacttcgacaagatggcccagatacccaatttccagaagaatctgtcctcacggaaggataagatcgacctgctgttcgaggagaacaacttcaagcccttcaagtacaacgacctgggcgccctggcctacctgggcagcgaaagagccattgccaccatccgtagcggcaagcggaccttctacaccggtggtggcctgatgaccttctacctgtggcggatcttgtacctgagcatgatcctgagcgcccgcagcagactgaaggtgttcttcgactggatcaagctggccttcttcaagagagacttcttcaagggcctgtga

SEQ ID NO: 55 - DNA, 1542 bp, Artificial Sequence
  source: /note="Description of Artificial Sequence: Synthetic polynucleotide"
atgctgagcaagaacttgtacagcaacaagcggctgctgaccagcaccaataccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtagacgagaagtccattatcgagcccatcgtgaacttcgccctgaagaaaaagggcaacgtcacctactacgaggcagaggccaccagcatcaaccccgaccggaacaccgtgaccatcaagagcctgagcgccgtgtcccagctgtaccagcccgagaaccacctgggcctgcaccaggccgagcccgccgagattaagtacgattacttaatcagcgccgtgggtgcggagcccaacacctttggaattcccggcgtgaccgattacggccacttcctgaaagagattcccaacagcctggaaatccggcggaccttcgccgccaacctggaaaaggccaacctgttgcctaagggcgaccccgagcggagaaggctgctgagcatcgtggtcgtgggcggaggccctacaggcgtggaagctgctggcgagctgcaggactacgtgcaccaggacctgcggaagttcctgcccgccctggccgaagaagtgcagattcacctggtggaagccctgcccatcgtgctgaacatgttcgagaagaagctgagcagctacgcccagagccacctggaaaacacctccatcaaggtgcacctgagaaccgccgtcgccaaggtggaagagaagcagctgttggccaagaccaagcacgaggacggcaagattaccgaggaaactatcccctacggcaccttgatttgggccaccggcaacaaggccagacccgtgatcaccgacctgttcaagaagatccctgagcagaacagcagcaagcggggcctggccgtgaacgacttcctgcaggtcaaaggcagcaacaacatcttcgccatcggcgacaacgcctttgccggcctgcctcctacagcccaggtggcccaccaagaagccgagtacctggccaagaacttcgacaaaatggcccagatccccaatttccagaagaacctatcctccagaaaggataagattgacctgctgttcgaggaaaacaacttcaagcccttcaagtacaacgacctgggcgccctggcctacctgggcagcgaaagagccattgccaccatcagaagcggcaagcggaccttctacaccggcggtggcctgatgaccttctacctgtggcggatcctgtacttgagcatgatcctaagcgccagaagcagactgaaggtgttcttcgactggatcaagctggccttcttcaagagggacttcttcaagggcctgtga

SEQ ID NO: 56 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccacaggcgtcgaaaacagcggggctggccccaccagcttcaagaccatgaaggtcatcgacccccagcacagcgacaagcccaacgtgctgatcctgggttctggctggggcgctatctcgtttctgaagcacatcgacaccaagaagtacaacgtctccatcatcagccccagaagctacttcctgttcacccccctgctgcccagcgcacctgtggggaccgtggacgaaaagtccatcatcgagcccatcgtgaacttcgccctgaagaaaaagggcaacgtcacctactacgaggccgaggccaccagcatcaaccccgaccggaacaccgtgaccatcaagagcctgagcgccgtgagccagctgtaccagcccgagaaccatctggggctgcaccaggccgagcccgccgagattaagtacgactacctgatcagcgccgtgggcgccgagcccaacacctttggaatccctggcgtgaccgattacggccacttcctgaaagagatccccaacagcctggaaatccggcggacctttgccgccaacctggaaaaggccaacctgctgcctaagggcgaccccgagcggagaagactactgagcatcgtggtcgtgggcggaggccccacaggcgtggaagccgctggcgagctgcaggactacgtgcaccaggacctgcggaagttcctccccgccctggccgaggaagtgcaaattcacctggtggaagctctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcactctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccgggttgcctccaacagcccaggtggcccaccaggaggccgagtacctggccaagaacttcgacaagatggcccagatccccaatttccagaagaacctgtcctcccggaaggataagatcgatctgctgttcgaggaaaacaacttcaagcccttcaagtacaacgacctgggcgccctggcctacctgggcagcgaaagagccattgccaccatcagaagcggtaagcggaccttctacaccggcggaggcctgatgaccttctacctgtggcggatcttgtacctgagcatgattctgagcgcccgcagcagactgaaggtgttcttcgactggatcaagctggccttcttcaagagggacttcttcaagggcctgtga

SEQ ID NO: 57 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggggtcgaaaactccggagctggccccacctctttcaagaccatgaaggtcatcgacccccagcacagcgacaagcccaacgtgctgatcctgggctctgggtggggcgccatcagctttctgaagcacatcgacaccaagaagtacaacgtcagcatcatcagccccagaagctacttcttattcacccccctgctgcccagcgcccctgtgggaaccgtggacgagaagtccatcattgagcccatcgtgaacttcgctctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggcagagcccgccgagattaagtacgactacctgatcagcgccgtgggcgccgagcctaacacatttggaatccccggcgtgaccgactacggccacttcctgaaagaaatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctacaggactacgtgcaccaggacctgagaaagtttctgcccgccctggccgaggaagtgcagattcacctggtggaagccctgcccatcgtgctgaacatgttcgagaagaagctgtcaagctacgcccagagccacctggaaaacacctccatcaaggtgcatctgagaaccgccgtggccaaggtggaagagaagcagctgctggccaagaccaagcacgaggacggtaagattaccgaggaaaccatcccctacggcaccctgatttgggccaccggcaacaaggccagacccgtaatcactgacctgttcaagaaaatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaggccgagtacctggccaagaatttcgacaagatggctcagatccccaatttccagaagaacctgtcctcccggaaggataagatcgacctcctgttcgaggaaaacaacttcaagcccttcaagtacaacgacctgggcgccctggcctacctgggcagcgaaagagccattgccaccatcagaagcggcaagcggaccttctacaccggcggaggcttaatgaccttctacctgtggcggatcctgtacctgagcatgattctgagcgcccgcagcagactgaaggtgttcttcgactggatcaagctggccttcttcaagagggacttcttcaagggactgtag

SEQ ID NO: 58 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgagattcgccagcaccagatccaccggcgtcgaaaacagcggggctggccccaccagcttcaagaccatgaaagtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccctctgctgcccagcgcccctgtgggaaccgtggacgagaagtccatcatcgagcccatcgtgaacttcgccctcaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtaggtgccgagcccaacacctttggaatccccggcgtgaccgactacggtcacttcctgaaagagatccccaacagcctggaaatccggcggaccttcgccgccaacctggaaaaggccaacctgctgcctaagggcgaccccgagcggagaaggctgctgtccattgtggtcgtgggcggaggccccacaggcgtggaagctgctggcgagctgcaggattacgtgcaccaggacctgcggaagttcctgcccgccctggccgaggaagtccagattcacctggtggaagccctgcccatcgtgctgaatatgttcgagaaaaagctgagcagctacgcccagagccacctggaaaacacctccatcaaggtgcacctgagaacggccgtggccaaggtggaagaaaagcagctgctggccaagaccaagcacgaggacggcaagataaccgaggaaaccatcccatacggcactctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgccacctaccgcccaggtggcccaccaggaagccgagtacctggccaagaacttcgataagatggcccagatccccaatttccagaagaacctatcttcacggaaggataagattgacctcctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggagaatcttgtacctgagcatgatcctgagcgcccgcagcagactgaaggtgttcttcgactggatcaagctggccttcttcaagagggacttcttcaagggcctgtag

SEQ ID NO: 59 - DNA, 1542 bp, Artificial Sequence
  source: /note="Description of Artificial Sequence: Synthetic polynucleotide"
atgctgagcaagaacctgtacagcaacaagaggctgctgacctcgaccaacacgctcgtgcgcttcgccagcaccagatccaccggcgtcgaaaacagcggggctggccccaccagcttcaagaccatgaaggtcattgacccccagcacagcgacaagcccaacgtgctgatcctgggctctggctggggcgccatcagctttctgaagcacatcgacaccaagaagtacaacgtcagcatcatcagccccagaagctacttcctgttcacccccctgttacccagcgccccagtgggaaccgtggacgagaagtccatcatcgagcccatcgtgaacttcgctctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgctgagattaagtacgactacctgatcagcgccgtgggcgccgagcccaacacctttggaatccccggcgtgactgactacggccacttcctgaaagagattcccaacagcctggaaatccggcggaccttcgccgccaacctggagaaggccaacttactgcctaagggtgatcccgagcggagaaggctgctgagcatcgtggtcgtgggcggaggccccacaggcgtggaagctgctggcgagctgcaggactacgtgcaccaggacctgagaaagttcctgcccgccctggccgaggaagtgcagattcacctggtggaagccctgcccatcgtgctgaacatgttcgagaagaagctgagcagctacgcccagagccacctggaaaacacttccatcaaggtgcacctgagaaccgccgtggccaaggtggaagagaagcagctgctggccaagaccaagcacgaggacggcaaaattaccgaggaaaccatcccatacggcaccctgatttgggccaccggtaacaaggcaagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaggccgagtatctggccaagaacttcgacaagatggcccagatccccaatttccagaagaacctgtcctcccggaaggataagatcgacctgctgttcgaggaaaacaacttcaagcccttcaagtacaacgatctgggcgccctggcctacctgggcagcgaaagggccattgcaaccatcagaagcggcaagagaaccttttacaccggcggaggcctgatgaccttctacctgtggagaatcctgtacctgagcatgatcctgagcgcacgcagcagactgaaggtgttcttcgactggatcaagctggccttcttcaagagggacttcttcaagggcctgtga

SEQ ID NO: 60 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaatttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcatcaagccgagcccgccgagattaagtacgactacttaatcagcgctgtaggcgccgagcccaacacctttggaatccccggcgtgaccgactacggccacttcctgaaagagatccccaacagcctggaaatcagacggactttcgccgccaacctggaaaaggccaacctgctgcctaagggtgatcccgagcggagaagactgctgagcatcgtggtcgtgggcggaggccccacaggcgtagaagctgctggcgagctgcaggactacgtgcaccaggacctgagaaagttcctgcccgccctggccgaggaagtgcagattcacctggtcgaagccctgcccatcgtgctgaacatgttcgagaagaagcttagcagctacgcccagagccatttagaaaacacctccatcaaggtgcacctgagaaccgccgtggccaaggtggaagagaagcaactgctggccaagaccaagcacgaggacggcaagattaccgaggaaaccatcccctacggcaccctgatttgggccaccggcaacaaggccagacccgtgatcactgaccttttcaagaagatccccgagcagaacagcagcaagcggggcctggcagtgaacgacttcctgcaggtcaaaggcagcaacaacatcttcgccatcggcgacaacgcctttgccggcctgcctcctacagcccaagtggcccaccaggaagccgagtacctggccaagaacttcgacaagatggcccagatccccaatttccagaagaacctgtcctcacggaaggataagatcgacctgctgttcgaggaaaacaacttcaagcccttcaaatacaacgatctgggcgccctggcctacctgggcagcgaaagagccattgccaccatcagaagcggcaagcggaccttctacaccggcggtggcttaatgaccttctacctgtggcggatcctgtacctgagcatgatcctgagcgcccgcagcagactgaaggtgtttttcgactggatcaagctggccttcttcaagagagacttcttcaagggcctgtga

SEQ ID NO: 61 - DNA, 1542 bp, Artificial Sequence
  source: /note="Description of Artificial Sequence: Synthetic polynucleotide"
atgctgagcaagaacttgtacagcaacaagcggctgctgaccagcaccaacacgctcgtgagattcgccagcaccagatccaccggggtcgaaaacagcggggctggccccaccagcttcaagaccatgaaggtcatcgacccccagcacagcgacaagcccaacgtgctgatcctgggctctggctggggcgccatttcgtttctgaagcacatcgacaccaagaagtacaacgtcagcatcatcagccccagaagctacttcctgttcacccccttgctgcccagcgcccctgtgggaaccgtggacgagaagtccatcatcgagcccatcgtgaacttcgccctgaagaaaaagggcaacgtcacctactacgaggccgaggccacctctatcaaccccgaccggaacaccgtgaccatcaaaagcctgagcgccgtgtcccagctataccagcccgaaaaccacctaggcctgcaccaggccgagcccgccgagattaagtacgactacctgatcagtgccgtgggcgccgagcccaacacctttggaatccccggcgtgaccgactacggccatttcctgaaagagatccccaacagcctggaaatccggcggaccttcgccgccaacctggagaaggccaacctgctgcctaagggcgaccccgagcggagaaggctgctgagcatcgtcgtcgtgggcggagggcccacaggcgtggaagctgctggcgagctgcaggactacgtgcaccaggacctgcggaagttcctgcccgccctggccgaagaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagattcccgagcagaacagcagcaagcggggcttggccgtgaacgacttcctgcaggtcaaaggcagcaacaacatcttcgccatcggcgacaacgcctttgccggcctgcctcctacagcccaggtggcccaccaggaagccgagtatctggccaagaactttgataagatggcccagatccccaatttccagaagaacctgtcctcacggaaggataagatcgatctgctgttcgaggaaaacaacttcaagcccttcaagtacaacgacctgggcgccttagcctacctgggcagcgaaagggccattgccaccatcagaagcggcaagcggaccttctacaccggcggaggcttaatgaccttctacctgtggcggatcctgtacctgagcatgatcctgagcgcccgcagcagattaaaggtgttcttcgactggatcaagctggccttcttcaagagggacttcttcaagggcctgtga

SEQ ID NO: 62 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 63 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaaatggcatttttcaaaagagacttttttaaaggattatag

SEQ ID NO: 64 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 65 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 66 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 67 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 68 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 69 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 70 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 71 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 72 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 73 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttagcgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 74 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 75 - DNA, 1542 bp, Artificial Sequence
  source: /note="Description of Artificial Sequence: Synthetic polynucleotide"
atgctgtcgaagaatctgtatagtaacaagcggttgctcacctcgacgaataccctagtgagattcgcttccaccagatccacaggggtggaaaactccggagcaggccctacatcttttaagaccatgaaagtcattgaccctcagcacagcgacaaacccaacgtgctgatactgggttcgggctggggagccatttcgtttctgaagcacattgacaccaagaagtacaacgtctccatcatctctcccagaagctatttcttattcacgcccttgttacccagcgcaccagtggggacagtagacgagaagtccattattgagcccatcgttaattttgctctcaagaaaaaggggaacgtcacctactatgaggcagaagccacctctatcaatcccgaccggaataccgttaccataaaatcactgtctgccgtgagccagctataccagcctgagaaccatctaggcctgcatcaagccgaacccgctgagattaagtacgattacctgatcagtgccgtgggcgcggaacccaacacatttggaatccctggcgtcaccgactacggtcacttcctgaaagaaattcccaactctttggaaatccggagaacttttgccgccaatctagagaaggctaacctgctgcctaagggtgatcccgaaagaagaagactgctgtccattgtcgtggttggtggagggcctacaggtgtagaggctgctggcgagctacaggattatgtgcaccaggacctgcggaagtttctccctgcattggccgaggaagtccagattcacttggtcgaagctctgcccatcgttttgaatatgtttgagaaaaagctgtcatcatacgcgcagagccatttagaaaacacttcgatcaaggtgcatctgagaaccgctgtcgccaaagtggaagaaaagcaattgttggccaagaccaagcacgaagacggtaaaataaccgaagaaactattccatacggtactttgatttgggccaccggtaacaaggcaagacccgtaatcaccgaccttttcaagaaaattcctgagcaaaactcgtccaagcggggcctggcagtgaatgactttttgcaggtgaaaggcagcaacaacattttcgccattggtgacaatgcatttgctgggttgccacctacagcccaagtagcgcaccaagaggccgaatatctggccaagaattttgataaaatggctcaaataccaaatttccagaagaatctatcctcacggaaggataaaatcgatctgctgttcgaggagaacaacttcaagcccttcaagtacaacgatctgggtgccctggcctacctgggatccgaaagggccattgcaaccatccgtagcggcaagagaaccttttacaccggtggtggcttaatgaccttctacctgtggagaattttgtacttgagcatgattctatctgcacgcagcagattaaaggtgttcttcgactggattaaaatggcctttttcaaaagagacttttttaaaggattatag

SEQ ID NO: 76 - DNA, 1542 bp, Artificial Sequence
  source: /note="Description of Artificial Sequence: Synthetic polynucleotide"
atgctatcgaagaatttgtacagcaacaagaggttgctcacctcgacgaatacgctcgtcagattcgcttccaccagatccaccggcgtcgaaaacagcggggctggtcctacatctttcaagaccatgaaagtcattgaccctcagcacagcgacaagccaaacgtgctgatactgggttcggggtggggagctatcagctttctgaagcacatcgacaccaagaagtacaacgtttccatcatctctcctagaagctacttcctgttcacgcctttgttaccttctgcacctgttgggacagtagacgagaagtcaattattgagcccatcgttaatttcgctctcaagaaaaaggggaacgttacctactatgaggcagaagccacctctatcaaccccgaccggaataccgttaccatcaaatcattatctgccgtgagccagctataccaacctgaaaaccatctagggctgcatcaggccgaacccgccgaaattaagtacgactatttaatcagcgctgtgggtgccgagcccaacacatttggtattcctggggtcactgattacggccatttcctggaggaaatccccaactctctggaaatcagaagaacttttgccgccaatctagagaaggccaacctgttgccaaagggtgatcccgaaagaagaagactactgtccatcgtcgtcgtgggtggtgggcctacaggcgtagaagctgctggcgagctgcaggactatgttcaccaggacctgagaaagtttctgcccgcactggccgaggaagtccaaattcacttggtcgaagccctgcccatcgttttgaacatgtttgagaagaagcttagcagctacgcgcaatcacatttagaaaacacttccatcaaagtgcatctgagaacggccgtcgccaaagttgaagaaaagcagttgttggcaaagaccaaacacgaagacggtaaaataaccgaggaaactatcccatacggtactctgatttgggccacgggtaacaaggcaagacccgtaatcactgaccttttcaagaaaattcctgagcagaactcgagcaagcggggattggccgtgaacgacttcttgcaggtcaaaggcagcaacaacattttcgccatcggcgacaatgcctttgctgggctgccacctaccgcccaggtagcgcaccaagaggccgagtatttggccaagaatttcgataaaatggctcaaataccaaatttccagaagaatctatcctccagaaaggataaaattgacctcttgttcgaggagaacaactttaaacctttcaaatacaacgatctgggcgccttagcatacctgggatccgaaagggccattgcaaccataagatccggtaagagaacattctacaccggcggtggcttaatgaccttctacttatggagaattttgtacttgtccatgatcctatctgcaagatcgagattaaaggtctttttcgactggatcaaactggcctttttcaagagagacttttttaagggcttatag

SEQ ID NO: 77 - DNA, 1542 bp, Artificial Sequence
  source: /note="Description of Artificial Sequence: Synthetic polynucleotide"
atgctatcgaagaatctgtacagtaacaagaggttgctcacctcgacgaacacgctagtcagattcgcctccaccagatccacaggcgtggaaaacagcggagctggtcctacatcttttaagaccatgaaagtcattgacccccagcacagcgacaagccaaacgtgctgatactgggttctggctggggcgccatttcgtttttaaagcacattgacaccaagaagtacaacgttagcatcatctctcctagaagctatttcctgtttacgcccttgctgcctagcgcacctgttgggacagtagacgaaaagtcaattatcgagcccatcgttaattttgctctcaagaaaaaggggaacgttacctactatgaggcagaagccacctctatcaatcccgaccggaataccgttaccatcaaaagcttatctgccgttagccagctataccaacccgagaaccatctaggcctgcatcaagcagagcccgctgaaattaagtacgattacttaatcagtgccgtgggcgcggagcccaacacctttggtattcctggcgtcactgactacggtcatttcctgaaggaaattcccaactctttggaaataagacggacctttgccgccaacctagagaaggctaacttattgccaaagggtgaccccgaacggagaaggctgctgtccatcgtcgtggttggtggtgggcccacaggtgtggaagctgctggtgagctacaggattatgtgcaccaggacctgagaaagtttctgcctgcattggccgaggaagtccaaattcacttggtcgaagccctgcccatcgtgttgaatatgttcgagaaaaagcttagctcatacgcgcaatcacatctggaaaacacttcgatcaaagtgcatctgagaacggctgtcgccaaggttgaagaaaagcaattgttggcaaagaccaagcacgaagacggtaaaattaccgaagaaaccattccatacggtaccctgatttgggccaccggcaacaaggcaagacccgtgatcactgaccttttcaagaaaattcctgagcaaaacagctccaagagaggactggcagtgaacgactttctgcaggtcaaaggcagcaacaacatcttcgccattggtgacaatgcctttgctggcttgccacctaccgcccaagtggcgcaccaagaggccgaatacatcgccaagaattttgataaaatggctcaaataccaaatttccaaaagaacctatcttcaagaaaggataagattgatctcttgttcgaggaaaacaactttaaacctttcaaatacaacgacctgggtgccttagcatacctgggatccgaaagggccattgcaaccataagaagcggtaagagaacattctacaccggtggaggcctgatgaccttctacttatggagaatcttgtacttgtccatgattctaagcgccagatcgagactgaaggtctttttcgactggatcaaattagccttcttcaaaagagactttttcaaaggattatag

SEQ ID NO: 78 - DNA, 1542 bp, Artificial Sequence
  source: /note="Description of Artificial Sequence: Synthetic polynucleotide"
atgctatcgaagaatttgtatagtaacaagcggttgctcacctcgacgaatacgctagtcagattcgcctccaccagatccaccggcgtggaaaactccggggcaggtcccacatctttcaagaccatgaaagtcattgaccctcagcacagcgacaaaccaaacgtgctgatcctgggctctggctggggagccattagctttctgaagcacattgacaccaagaagtacaacgtctccatcatctctcctagaagctatttcctgtttacgcctttgttacctagcgcccctgtggggacagtagacgaaaagtcaattatcgagcccatcgttaacttcgccctcaagaaaaaggggaacgtcacctactacgaggcagaagccacctctatcaatcccgaccggaataccgtgaccataaaatcattatctgccgttagccagctataccagcctgaaaaccatctagggctgcatcaagccgaacctgctgagattaagtacgattatttaatcagcgctgtaggcgcggaacccaacacatttggtattcctggcgtcactgattacggtcatttcctgaaggaaattcccaactctctggaaataagacggacttttgccgccaacctggagaaggccaacttactgcctaagggcgaccccgaaagaagaagactactgtccattgtggtcgttggtggagggcccactggtgtggaggccgctggtgagctacaggactatgttcaccaggacctgagaaagttcctccccgcactggccgaggaagtccaaattcacttggtcgaagctctgcccatcgttttgaatatgtttgagaagaagctgtcatcatacgcccaatcacacttagaaaacacttcgatcaaagtgcatctgagaaccgctgtcgccaaagttgaagaaaagcaattgctggcaaagaccaaacacgaagacggtaaaattaccgaggaaaccattccatacggcaccttgatttgggccacgggcaacaaggcaagaccggtaatcactgaccttttcaagaaaattcctgagcagaactcgtccaagagaggcttggcagtgaatgactttttgcaggtgaaaggcagcaacaacatcttcgccatcggcgacaatgcatttgctgggctgcctccaaccgcccaagtagcgcaccaggaggccgaatatttggccaagaactttgataaaatggctcagatacccaatttccaaaagaatctatcttccagaaaggataagattgatctgctgttcgaggagaacaactttaaacctttcaagtacaacgacttaggcgccttagcctacctgggatccgaaagagccattgccaccatccgttccggtaagagaaccttctacaccggtggaggcctgatgaccttctacttatggcggattttgtacttgtccatgattctatctgcaagaagcagattaaaggtctttttcgactggatcaaattagcatttttcaagagagacttctttgagggattatga

SEQ ID NO: 79 - DNA, 1542 bp, Artificial Sequence
  source: /note="Description of Artificial Sequence: Synthetic polynucleotide"
atgctatcgaagaatctgtatagcaaccggaggttgctcacctcgacgaatacgctagtcagattcgctagcaccagatccacaggcgtggaaaactccggggctggtcctaccagctttaagaccatgaaagtcatcgaccctcagcacagcgacaaaccaaacgtgctgatactgggttcggggtggggagctatttcgtttttaaagcacatcgacaccaagaagtacaacgtttccatcatctctcccagaagctatttcttatttacgcctctgttaccttctgcaccagttgggacagtggacgaaaagtccattattgagcccatcgtgaatttcgccctgaagaaaaagggcaacgttacctactatgaggcagaagccaccagcatcaatcccgacaggaacaccgttaccataaaaagcttatctgccgtgagccagctataccagcctgaaaaccatctagggctgcatcaagcagaacctgctgaaattaagtacgattatttaatcagtgccgtaggtgccgaacccaacacatttggtattcctggggtgactgattacggtcacttcctgaaggagatccccaacagcctggaaatacggcggacttttgccgccaatctagagaaggctaacttattgccaaagggcgaccccgagagaagaagactactgtccattgtcgtcgttggcggagggcccactggtgtagaggccgctggtgaactacaggattacgttcaccaggacctgagaaagttcctccccgcactggccgaggaagtgcaaattcacctggtcgaagctctgcccatcgttctgaatatgtttgagaagaagctttcatcatacgcccaaagccatctggaaaacacttcgatcaaggtacatctgagaacggccgtggccaaagtggaagagaagcaattgctggcaaagaccaaacacgaagacggcaaaataaccgaagaaaccattccatacggcactttgatttgggccacgggtaacaaggcaagaccggtaatcactgacctgttcaagaaaattcctgagcaaaacagctccaagagaggactggccgtgaacgactttttgcaggtgaaaggcagcaacaacatcttcgccattggtgacaacgcctttgccgggctgccaccaacagcccaggtagcgcaccaagaggccgaatacctggccaagaacttcgataaaatggcccaaataccaaatttccaaaagaatctgtcttcacggaaggataagatcgacctcctgttcgaggagaacaactttaaacctttcaaatacaacgatttaggtgccttagcatacctgggatccgaaagggccattgcaaccataagatccggtaagagaaccttttacaccggtggtggcttaatgaccttctacttatggcggattttgtacttgtccatgattctgagcgcccgcagcagactgaaggtctttttcgactggatcaagttagcctttttcaaaagagacttttttaagggattatga

SEQ ID NO: 80 - DNA, 1542 bp, Artificial Sequence
  source: /note="Description of Artificial Sequence: Synthetic polynucleotide"
atgctatcgaagaatttgtatagtaacaagaggctgctcacctcgaccaatacgctagtcagattcgcttccaccagatccacaggggtggaaaacagcggggctggccccaccagctttaagaccatgaaagtcattgaccctcagcacagcgacaaaccaaacgtgctgatactgggttctgggtggggagctatctcgtttttaaagcacattgacaccaagaagtacaacgtttccatcatctctcctagaagctatttcttattcacccccttgttacctagcgcaccagttgggaccgtagacgaaaagtcaattatcgagcccatcgttaatttcgctctcaagaaaaaggggaacgtcacctactacgaggcagaggccacctctatcaaccccgacaggaacaccgttaccataaaatcactgtctgccgtgtcccagctgtaccaacccgaaaaccatctagggctgcatcaagcagagcctgctgagattaagtacgattacctgatcagtgctgtaggtgcggaacccaacacatttggtattcccggggtgactgattacggtcatttcctgaaagagatccccaactctctggaaataagaagaacttttgccgccaatctggaaaaggccaacttattgcctaagggcgatcccgaaagaagaagactgctgtccattgtggtggttggtggtgggcctactggcgtggaggccgctggtgaactgcaggattatgtgcaccaggacctgagaaagtttctccccgcattggccgaggaagtgcaaattcacttggtggaagccctgcccatcgttctgaatatgttcgagaaaaagctttcatcatacgcccaatcacatttagaaaacacttccatcaaagtacatctgagaacggccgtcgccaaagtggaagaaaagcagttgctggcaaagaccaaacacgaagacggcaagataaccgaagaaactattccatacggcactttgatttgggccacgggcaacaaggcaagaccggtgatcaccgaccttttcaagaaaattcctgagcaaaacagcagcaagagaggcttggcagtgaatgactttttgcaggtcaaaggcagcaacaacattttcgccatcggcgacaatgcatttgctggcctgccaccaaccgcccaagtagcgcaccaggaggccgagtatttggccaagaattttgataaaatggcccagatacccaatttccaaaagaacctatcttccagaaaggataagatcgatctcttgttcgaggagaacaactttaaacctttcaaatacaacgatctgggcgccttagcatacctgggatccgaaagggccattgccaccatccgttccggcaagcggacattttacaccggcggtggcttaatgaccttctacttatggagaatcttgtacttgagcatgattctaagcgcaagatcgagattaaaggtcttcttcgactggattaaattagcatttttcaaaagagactttttcgagggactgtag

SEQ ID NO: 81 - DNA, 1542 bp, Artificial Sequence
  source: /note="Description of Artificial Sequence: Synthetic polynucleotide"
atgctgtcgaagaacttgtatagcaacaagaggctgctgacctcgacgaacacgctcgtcagattcgccagcaccagatccacaggcgtggaaaacagcggggctggtcccacatcttttaagaccatgaaagtcattgaccctcagcacagcgacaagccaaacgtgctgatcctgggttcggggtggggcgctatctcgtttttaaagcacattgacaccaagaagtacaacgtctccatcatcagccccagaaagtatttcctgtttacgcctttgttaccttctgcacctgttgggaccgtagacgagaagtccattattgagcccatcgtgaatttcgctctgaagaaaaaggggaacgttacctactatgaggccgaagccacctctatcaatcccgacaggaacaccgttaccatcaaatcattatctgccgttagccagctataccaacccgaaaaccacctggggctgcatcaagcagagcctgccgaaattaagtacgattacttaatcagcgccgtaggtgccgaacctaacacctttggtattcctggcgtcaccgattacggtcatttcctgaaggaaattcccaactctttggaaataagacggactttcgccgccaatctagagaaggccaacttattgcctaagggtgatcccgagagaagaagactgctgtccattgtcgtcgttggtggtgggcctactggtgtagaggccgctggtgagctacaggattatgttcaccaggacctgagaaagtttctccccgccttggccgaagaagtgcagattcacctggtcgaagctctgcccatcgttttgaatatgtttgagaaaaagctttcaagctacgcgcaaagccatctggaaaacacttcgatcaaagtgcatctgagaaccgctgtcgccaaagttgaagaaaagcaattgctggccaagaccaaacacgaagacggcaagataaccgaagaaactatcccatacggtactttgatttgggccacgggtaacaaggccagaccggtaatcactgaccttttcaagaaaattcctgagcagaactcgtccaagcggggattggcagtgaatgactttttgcaggtgaaaggcagcaacaacattttcgccatcggtgacaatgcctttgccgggttgcctcctaccgcccaagtggcgcaccaagaggccgaatacctggccaagaatttcgataaaatggctcaaataccaaatttccagaagaatctgtcctcccggaaggataaaattgatctgctgttcgaggaaaacaactttaaacctttcaaatacaacgacttaggtgccttagcatacctgggaagcgaaagggccattgcaaccatacgttccggcaagagaacattttacaccggtggtggcctgatgaccttctacctgtggcggattttgtacctgtccatgatcctatctgccagatcgagattaaaggtctttttcgactggattaaattagcattcttcaaaagagacttttttaaaggcctgtga

SEQ ID NO: 82 - DNA, 1542 bp, Artificial Sequence
  source: /note="Description of Artificial Sequence: Synthetic polynucleotide"
atgctaagcaagaacttgtatagtaacaagaggttgctgacctcgaccaatacgctagtcagattcgctagcaccagatccaccggggtggaaaactccggagcaggccctacaagctttaagaccatgaaagtcattgaccctcagcacagcgacaaaccaaacgtgctgatactgggttctgggtggggagctatctcgtttttaaagcacattgacaccaagaagtacaacgttagcatcatctctcctagaagctatttcttattcacgcctttgttaccttctgccccagttggaacagtggacgaaaagtccattattgagcccatcgtgaattttgctctcaagaaaaagggcaacgttacctactacgaggcagaagccaccagcatcaaccccgacaggaataccgttaccatcaagtcactgtctgccgttagccagctataccaacctgagaaccatctaggcctgcaccaagccgaacctgccgaaattaagtacgattatttaatcagtgctgtaggtgccgaacctaacacatttggaattcctggggtcactgattacggtcacttcctgaaggagatccccaacagcctggaaatcagaagaaccttcgccgccaatctagagaaggccaacttactgccaaagggtgatcccgaaagaagaagactactgtccattgtggtcgtgggcggtgggcctactggtgtagaggccgctggtgaactacaggattacgttcaccaggacctgcggaagttcctccctgcactggccgaagaagtccaaattcacttggtggaagctctgcccatcgttttgaatatgtttgagaaaaagctttcaagctacgcgcaatcacatctggaaaacacttccatcaaggtacatctgagaacggctgtcgccaaagttgaagagaagcagctgttggcaaagaccaaacacgaagacggcaaaataaccgaagaaactattccctacggcactctgatttgggccacgggtaacaaggcaagaccggtaatcactgaccttttcaagaaaattcccgagcaaaacagctccaagagaggattggcagtgaatgactttttgcaggtgaaaggcagcaacaacatcttcgccattggtgacaacgcatttgccggcttgccacctacagcccaagtagcccaccaggaagccgagtacatcgccaagaactttgataaaatggctcagataccaaatttccagaagaacctatcttccagaaaggataagattgacctcttgttcgaggaaaacaactttaaacccttcaaatacaacgatttaggtgccttagcatacctgggctccgaaagagccattgccaccataagatccggcaagagaaccttctacaccggtggaggcctgatgaccttctacttatggcggattttgtacttgtccatgatcctatctgcaagaagcagattaaaggtgtttttcgactggattaaactggcatttttcaaaagggactttttcaaaggattatag

SEQ ID NO: 83 - DNA, 1542 bp, Artificial Sequence
  source: /note="Description of Artificial Sequence: Synthetic polynucleotide"
atgctatcgaagaacttgtatagtaacaagcggttgctcacctcgacgaacacgctagtgcgcttcgcctccaccagatccacaggggtcgaaaactccggagctggccctacatcttttaagaccatgaaagtcattgaccctcagcacagcgacaaacccaacgtgctgatcctgggttcgggctggggagctatttcgtttttaaagcacattgacaccaagaagtacaacgtttccatcatctctcctagaagctatttcttacacacgcctttgttacctagcgcaccagtgggaaccgtagacgagaagtcaattatcgagcccatcgttaactttgctctcaagaaaaaggggaacgttacctactatgaggcagaagccacctctatcaatcccgaccggaataccgtgaccataaagagcttatctgccgttagccagctgtaccaacctgaaaaccatctggggctgcaccaagcagaacccgctgaaattaagtacgactacttaatcagtgccgtaggcgccgagcccaacacatttggtattcctggcgtcactgattacggccatttcctgaaagaaattcccaactctctggaaatacggagaacttttgccgccaatctagagaaggccaacttattgcctaagggtgaccccgaaagaagaagactgctgagcattgtcgtggttggtggtggccccactggtgtggaggctgctggtgaactacaggactacgttcaccaggacctgagaaagttcctgcctgcactggccgaagaagtgcaaattcacttggtggaagctctgcccatcgttttgaatatgttcgagaagaagctttcatcatacgcccaatcacatttagaaaacacttccatcaaggtacacctgagaaccgctgtggccaaagttgaagagaagcaactgttggcaaagaccaaacacgaagacggtaaaataaccgaggaaactattccatacggtaccctgatttgggccacgggcaacaaggcaagaccggtaatcaccgaccttttcaagaaaattcctgagcaaaactcgtccaagagaggattggcagtgaatgacttcttgcaggtgaaaggcagcaacaacatcttcgccatcggcgacaatgcctttgctgggctgcctccaaccgcccaagtagcccaccaagaggccgagtacttggccaagaatttcgataaaatggctcaaataccaaatttccaaaagaatctatcttccagaaaggataaaattgacctcttgttcgaggaaaacaactttaaacctttcaaatacaacgatttaggtgccttagcctacctgggaagcgaaagagccattgccaccataagaagcggtaagagaacattctacaccggtggtggcttaatgaccttctacttatggagaattctgtacctgtccatgattctatctgcaagatcgagactgaaggtgtttttcgactggattaagttagcctttttcaagagagacttctttaaaggcttatag

SEQ ID NO: 84 - DNA, 1542 bp, Artificial Sequence
  source: /note="Description of Artificial Sequence: Synthetic polynucleotide"
atgctgagcaagaatttgtacagcaacaagaggttgctcaccagcaccaacacgctcgtgagattcgcctccaccagatccacaggcgtcgaaaactccggagctggccccacaagcttcaagaccatgaaagtcattgaccctcagcacagcgacaagcccaacgtgctgatactgggttcgggctggggagctatctcgtttttaaagcacatcgacaccaagaagtacaacgtttccatcatctctcccagaaagtatttcctgtttacccccctgttaccctctgcacctgttgggaccgtggacgaaaagtccattatcgagcccatcgtgaattttgctctgaagaaaaagggcaacgtcacctactatgaggcagaagccacctctatcaatcccgaccggaataccgttaccatcaaaagcttatctgccgttagccagctataccaacctgaaaaccatctggggctgcatcaagcagaacctgctgaaattaagtacgattatttaatcagtgctgtaggcgcggaacctaacacatttggaattcctggggtcactgattacggtcatttcctgaaggaaattcccaactctttggaaatcagaagaacttttgccgccaacctggagaaggctaacttattgccaaagggtgatcccgaaagaagaaggctactgagcattgtcgtggtgggtggtgggcccacaggtgtggaggccgctggtgaactgcaggactatgtgcaccaggacctgcggaagttcctccctgccctggccgaagaagtccagattcacttggtcgaagctctgcccatcgttttgaacatgtttgagaaaaagctttcaagctacgcgcaaagccatctggaaaacacttccatcaaagtacacctgagaacggccgtggccaaggttgaagaaaagcaattgttggcaaagaccaaacacgaagacggtaaaataaccgaagaaactattccctacggtactttgatttgggccacgggtaacaaggcaagaccggtaatcactgaccttttcaagaaaattcctgagcaaaactcgtccaagagaggcttggcagtgaatgactttttgcaggtcaaaggcagcaacaacattttcgccattggcgacaatgcatttgccgggctgcctccaaccgcccaagtagcgcaccaagaagccgaatatttggccaagaattttgataagatggctcaaataccaaatttccaaaagaatctatcctccagaaaggataagattgacctcttgttcgaggagaacaactttaaacccttcaaatacaacgacctgggcgccttagcatacctgggatccgaaagagccattgcaaccatacgttccggtaagagaacattttacaccggtggaggcctgatgaccttctacttatggcggatcttgtacttgtccatgattctaagcgcccgcagcagattaaaggtctttttcgactggattaaactggccttcttcaaaagagacttctttaaaggcttatag

SEQ ID NO: 85 - DNA, 1542 bp, Artificial Sequence
  source: /note="Description of Artificial Sequence: Synthetic polynucleotide"
atgctgagcaagaacttgtatagcaacaagaggttgctcacctcgacgaatacgctcgtcagattcgcttccaccagatccaccggggtcgaaaacagcggggcaggtcctacatctttcaagaccatgaaggtcattgaccctcagcacagcgacaaacccaacgtgctgatactgggttcggggtggggcgctatttcgtttttaaagcacattgacaccaagaagtacaacgtttccatcatctctcctagaagctacttcttatttacccctttgttacccagcgccccagttgggacagtagacgaaaagtccattattgagcccatcgttaactttgctctgaagaaaaaggggaacgttacctactatgaggcagaggccacctctatcaaccccgacaggaacaccgttaccatcaaatcattaagcgccgtttcccagctataccagcctgaaaaccatctagggctgcatcaagcagaacccgccgaaattaagtacgattatttaatcagcgctgtaggtgcggaacctaacacatttggtattcctggcgtcactgactacggccatttcctgaaggagattcccaacagcttggaaatcagaagaactttcgccgccaatctagaaaaggctaacttattgcctaagggcgatcccgaacggagaagactactgtccattgtcgtcgtgggtggagggcccactggtgtagaggccgctggcgagctgcaggactatgttcaccaggacctgagaaagtttctccccgcattggccgaggaagtccaaattcacctggtcgaagctctgcccatcgtgctgaacatgtttgagaaagagctgagctcatacgcgcaatcacatttagaaaacacttcgatcaaagtacatctgagaaccgccgtcgccaaagtggaagagaagcaattgctggccaagaccaaacacgaggacggtaaaataaccgaagaaactattccctacggtactttgatttgggccaccggtaacaaggcaagacccgtgatcaccgaccttttcaagaagatccctgagcaaaactcgtccaagcggggattggcagtgaatgactttttgcaggtcaaaggcagcaacaacatcttcgccatcggtgacaatgcatttgctgggttgccaccaaccgcccaggtagcgcaccaagaagccgaatacttggccaagaatttcgataaaatggctcaaatccccaatttccaaaagaatctgtcttccagaaaggataaaatcgatctcttgttcgaggagaacaacttcaaacctttcaagtacaacgatttaggtgccttagcatacctgggcagcgaaagggccattgcaaccatacgtagcggtaagagaacattttacaccggtggtggcctgatgaccttctacctgtggcggattttgtacttgtccatgattctatctgcacgcagcagattaaaggtctttttcgactggattaaattagccttcttcaaaagggactttttcaaaggcttatag

SEQ ID NO: 86 - DNA, 1542 bp, Artificial Sequence
  source: /note="Description of Artificial Sequence: Synthetic polynucleotide"
atgctaagcaagaatttgtatagtaacaagaggttgctcacctcgacgaatacgctagtcagattcgcttccaccagatccacaggggtggaaaactccggagcaggtcctacctctttcaagaccatgaaggtcattgacccccagcacagcgacaaaccaaacgtgctgatactgggttcggggtggggcgctatttcgtttctgaagcacattgacaccaagaagtacaacgtttccatcatctctcccagaagctatttcttatttacgcctttgctgccttctgcaccagttgggaccgtagacgagaagtccattattgagcccatcgttaattttgctctcaagaaaaaggggaacgttacctactatgaggcagaggccaccagcatcaatcccgacaggaacaccgtgaccataaaatcattatctgccgttagccagctataccaacctgaaaaccacctggggctgcaccaggcagaacccgccgagattaagtacgactacctgatcagtgctgtgggcgccgagcctaacacatttggtattcctggggtcactgactacggccatttcctgaaagagattcccaactctttggaaataagaagaactttcgccgccaatctggagaaggctaacttactgccaaagggtgatcccgaaagaagaagactactgtccattgtggtggttggtggaggccctactggcgtggaggccgctggtgaactgcaggactatgtgcaccaggacctgcggaagttcctgcctgccttggccgaagaagtccaaattcacttggtggaagctctgcccatcgtgttgaatatgtttgagaaaaagctttcatcatacgcccaaagccacttagaaaacacttcgatcaaagtgcatctgagaacggctgtcgccaaagttgaagagaagcaactgttggccaagaccaaacacgaggacggtaaaataaccgaagaaactattccctacggtactttgatttgggccaccggcaacaaggccagacccgtgatcactgaccttttcaagaaaatccccgagcaaaactcgagcaagagaggattggcagtgaatgacttcttgcaggtgaaaggcagcaacaacattttcgccattggtgacaatgcatttagcgggttgcctcctaccgcccaagtagcgcaccaagaggccgaatatctggccaagaactttgataaaatggctcagatcccaaatttccagaagaacctgtcttcacggaaggataaaattgacctcttgttcgaggaaaacaacttcaagcctttcaaatacaacgacttaggcgccttagcatacctgggctccgaaagggccattgccaccataagatccggtaagcggaccttttacaccggtggtggcttaatgaccttctacttatggagaattttgtacctgagcatgatcctatctgccagaagcagattaaaggtctttttcgactggatcaaattagcatttttcaagagggacttttttaagggcttatag

SEQ ID NO: 87 - DNA, 1542 bp, Artificial Sequence
  source: /note="Description of Artificial Sequence: Synthetic polynucleotide"
atgctatcgaagaatttgtatagcaacaagaggttgctcacctcgaccaacacgctagtgagattcgctagcaccagatccaccggggtggaaaactccggggcaggtcccacaagcttcaagaccatgaaagtcattgacccccagcacagcgacaaacccaacgtgctgatactgggttcgggctggggcgctatttcgtttttaaagcacattgacaccaagaagtacaacgttagcatcatctctcccagaagctatttcttatttacgcctctgttaccttctgcaccagtggggacagtagacgagaagtccattattgagcccatcgttaattttgctctcaagaaaaaggggaacgttacctactatgaggcagaggccacctctatcaatcccgacaggaacaccgttaccatcaagtcattaagcgccgtgtcccagctataccaacccgaaaaccatctagggatgcatcaggcagagcctgccgagattaagtacgactatttaatcagtgctgtgggtgcggagcctaacacatttggaattcctggggtcactgattacggccatttcctgaaggagattcccaactctctggaaataagaagaacctttgccgccaatctagagaaggctaacctgctgcctaagggcgaccccgaaagaagaagactgctgagcattgtcgtggtgggtggaggccctactggtgtagaggctgctggtgaactacaggactacgttcaccaggacctgcggaagtttctccctgcattggccgaagaagtccagattcacctggtcgaagccctgcccatcgttttgaacatgtttgagaaaaagctgtcatcatacgcgcagagccatctggaaaacacttccatcaaagtacatctgagaaccgctgtggccaaagttgaagaaaagcaattgttggcaaagaccaaacacgaagacggcaaaataaccgaagaaactattccctacggtactctgatttgggccacgggtaacaaggcaagaccggtaatcaccgaccttttcaagaagattcctgagcaaaactcgtccaagcggggcttggccgtgaatgacttcctgcaggtgaaaggcagcaacaacattttcgccattggcgacaatgcatttgctgggctgccaccaaccgcccaagtagcgcaccaggaggccgaatatttggccaagaactttgataaaatggctcaaataccaaatttccagaagaacctatcctccagaaaggataaaattgacctcttgttcgaggagaacaactttaaacctttcaagtacaacgatttaggtgccctggcatacctgggatccgaaagggccattgccaccatcagatccggcaagagaacattttacaccggtggaggcttaatgaccttctacttatggcggattctgtacttgtccatgatcctgagcgcaagaagcagactgaaggtctttttcgactggattaaattagcatttttcaaaagagacttcttcaaaggattatag

SEQ ID NO: 88 - DNA, 1542 bp, Artificial Sequence
  source: /note="Description of Artificial Sequence: Synthetic polynucleotide"
atgctatcgaagaacctgtatagtaacaagcggttgctcaccagcacgaacacgctagtcagattcgcttccaccagatccaccggggtggaaaacagcggagcaggtcctacatcttttaagaccatgaaggtcattgaccctcagcacagcgacaagccaaacgtgctgatactgggttctgggtggggagctatttcgtttttaaagcacattgacaccaagaagtacaacgtttccatcatctctcccagaaagtacttcttattcacccctttgctgcctagcgccccagttggaaccgtagacgagaagtccattattgagcccatcgttaattttgccctcaagaaaaaggggaacgttacctactatgaggcagaagccacctctatcaatcccgacaggaataccgtgaccataaaatcactgtctgccgtttcccagctataccaacctgaaaaccatctaggcctgcatcaagcagagcctgctgaaattaagtacgattatttaatcagtgctgtgggcgcggagcccaacacatttggaattcctggggtgactgactacggccatttcctgaaggagatccccaactctttggaaatcagaagaactttcgccgccaatctagagaaggctaacctgttgcctaagggcgatcccgaaagaagaagactactgagcattgtcgtggttggtggtgggcctactggcgtagaagccgctggtgaactgcaggattatgtgcaccaggacctgagaaagtttctgcctgcactggccgaagaagtccagattcacttggtcgaagctctgcccatcgttctgaatatgtttgagaagaagctttcatcatacgcgcaatcacatttagaaaacacttccatcaaagtgcatctgagaacggccgtggccaaggttgaagaaaagcagctgttggcaaagaccaagcacgaagacggtaaaataaccgaagaaaccattccatacggcactctgatttgggccacgggtaacaaggcaagaccggtaatcactgacctgttcaagaagattcccgagcaaaactcgtccaagcggggcctggcagtgaatgacttcttgcaggtgaaaggcagcaacaacatcttcgccatcggcgacaatgcatttgctgggctgccaccaaccgcccaagtggcgcaccaggaggccgaatatttggccaagaatttcgacaagatggctcagatcccaaatttccagaagaatctatcttcaagaaaggataaaattgatctcctgttcgaggagaacaacttcaagcctttcaagtacaacgatttaggtgccttagcatacctgggctccgaaagagccattgccaccataagatccggcaagagaaccttctacaccggtggtggcttaatgaccttctacttatggcggattttgtacttgtccatgattctgtctgcccgctcgagattaaaggtcttcttcgactggattaaattagcatttttcaagagggacttttttaaaggattatag

SEQ ID NO: 89 - DNA, 1542 bp, Artificial Sequence
  source: /note="Description of Artificial Sequence: Synthetic polynucleotide"
atgctaagcaagaatttgtatagtaacaagaggttgctgaccagcacgaatacgctagtgagattcgcttccaccagatccacaggggtggaaaactccggagcaggtcccacaagcttcaagaccatgaaagtcattgacccccagcacagcgacaaacccaacgtgctgatactgggttcggggtggggagctattagctttttaaagcacattgacaccaagaagtacaacgtttccatcatcagccccagaagctacttcttatttacgcctttgttacccagcgccccagtggggacagtagacgaaaagtccatcattgagcccatcgtgaacttcgctctgaagaaaaagggcaacgtcacctactatgaggcagaagccacctctatcaatcccgacaggaataccgttaccatcaaaagcctgtctgccgtgagccagctataccaacctgaaaaccacctggggctgcaccaagcagaacctgctgaaattaagtacgactatttaatcagcgctgtaggtgcggaacctaacacatttggtatccctggggtcactgactacggtcatttcttcaaagaaattcccaactctttggaaataagaagaacttttgccgccaatctagagaaggctaacttattgcctaagggtgatcccgaacggagaagactactgtccattgtcgtggttggtggtgggcctacaggcgtagaggccgctggcgagctgcaggattacgtgcaccaggacctgcggaagtttctgcccgcactggccgaagaagtccaaattcacttggtggaagccctgcccatcgtgctgaatatgttcgagaaaaagctttcatcatacgcgcagtcacacttagaaaacacttccatcaaggtacatctgagaacggctgtcgccaaggttgaagaaaagcagttgttggccaagaccaaacacgaagacggtaaaataaccgaagaaactatcccatacggtactttgatttgggccaccggtaacaaggccagaccggtaatcactgacctgttcaagaaaatccctgagcaaaactcgtccaagagaggactggcagtgaatgactttttgcaggtgaaaggcagcaacaacattttcgccattggtgacaacgcatttgctgggctgcctccaacagcccaggtagcccaccaagaggccgaatatctggccaagaacttcgataaaatggctcagataccaaatttccaaaagaacctatcctcacggaaggataagattgacctcttgttcgaggagaacaactttaaacctttcaaatacaacgatttaggtgccttagcatacctgggatccgaaagggccattgcaaccataagaagcggtaagcggacattctacaccggtggtggcctgatgaccttctacctgtggcggatcttgtacctgtccatgatcctatctgcaagatcgagattaaaggtgttcttcgactggattaaactggcatttttcaagagagacttcttcaaaggattatga

SEQ ID NO: 90 - DNA, 1542 bp, Artificial Sequence
  source: /note="Description of Artificial Sequence: Synthetic polynucleotide"
atgctatcgaagaatttgtatagtaacaagaggttgctgacctcgacgaacacgatggtcagattcgcttccaccagatccacaggcgtcgaaaacagcggagcaggtcccaccagcttcaagaccatgaaagtcatcgaccctcagcacagcgacaaaccaaacgtgctgatactgggttcggggtggggagctatttcgtttttaaagcacattgacaccaagaagtacaacgtttccatcatctctcctagaagctacttcctgtttacgcccttgttacctagcgcaccagtggggaccgtagacgaaaagtcaattattgagcccatcgtgaattttgctctcaagaaaaaggggaacgttacctactatgaggccgaggccacctctatcaaccccgacaggaataccgtgaccataaaatcattatctgccgttagccagctgtaccaacctgaaaaccatctggggctgcaccaagccgaacctgctgaaattaagtacgattacttaatcagcgccgtaggcgcggagcctaacacatttggtattcctggggtcactgattacggccatttcctgaaggagattcccaactctctggaaataagaagaacctttgccgccaacctagaaaaggctaacctgttgcctaagggcgatcccgaacggagaagactactgtccattgtggtggttggtggaggccctactggcgtagaggctgctggcgaactacaggattacgttcaccaggacctgcggaagtttctccccgccttggccgaggaagtgcaaattcacttggtcgaagctctgcccatcgttctgaatatgtttgagaagaagcttagctcatacgcgcaatcacacttagaaaacacctccatcaaggtacatctgagaacggctgtcgccaaagttgaagagaagcaactgctggcaaagaccaagcacgaagacggcaagataaccgaggaaactattccatacggtaccttgatttgggccaccggtaacaaggcaagacccgtgatcaccgaccttttcaagaaaatccctgagcagaactcgtccaagagaggattggcagtgaatgactttttgcaggtcaaaggcagcaacaacattttcgccatcggcgacaatgcctttgccgggctgcctcctaccgcccaagtagcgcaccaagaggccgaatatttggccaagaattttgataaaatggctcagatacccaatttccaaaagaatctatcttcaagaaaggataaaattgatctcttgttcgaggagaacaactttaagcctttcaagtacaacgatctgggtgccttagcatacctgggatccgaaagggccattgcaaccataagatccggcaagagaacattttacaccggcggtggcttaatgaccttctacttatggagaattctgtacctgtccatgatcctgtctgcaagaagcagactgaaggtctttttcgactggattaaactggcattcttcaaaagagacttttttaaaggcctgtag

SEQ ID NO: 91 - DNA, 1542 bp, Artificial Sequence
  source: /note="Description of Artificial Sequence: Synthetic polynucleotide"
atgctgagcaagaatttgtacagcaacaagaggctgctcacctcgacgaatacgctcgtgagattcgcttccaccagatccacaggcgtcgaaaactccggagcaggtcctacaagcttcaagaccatgaaggtcatcgaccctcagcacagcgacaaaccaaacgtgctgatactgggctctgggtggggcgccatttcgtttttaaagcacattgacaccaagaagtacaacgtttccatcatcagccctagaaagtacttcttatttacgcccctgttaccttctgcccctgttgggaccgtagacgaaaagtcaattattgagcccatcgtgaatttcgctctcaagaaaaagggcaacgtcacctactatgaggcagaagccacctctatcaatcccgacaggaacaccgttaccataaaaagcttatctgccgttagccagctataccaacccgagaaccatctggggctgcaccaggccgaacctgctgaaattaagtacgactatttaatcagtgccgtaggcgcggaacctaacacatttggtatccctggggtcaccgattacggtcatttcctgaaagaaattcccaactctctggaaatacggcggaccttcgccgccaacctagagaaggctaacttattgccaaagggtgatcccgaaagaagaagactactgagcattgtcgtggtgggtggaggccctactggcgtagaagctgctggtgagctgcaggattatgtgcaccaggacctgagaaagtttctgcctgcattggccgaagaagtccagattcacttggtggaagctctgcccatcgttctgaacatgtttgagaaaaagctttcatcatacgcgcaatcacatttagaaaacacttcgatcaaagtacatctgagaacggccgtcgccaaagttgaagagaagcagctgctggcaaagaccaaacacgaggacggcaaaataaccgaagaaactattccatacggtactttgatttgggccacgggtaacaaggcaagacccgtaatcactgaccttttcaagaaaattcccgagcaaaactcgtccaagagaggattggccgtgaacgactttttgcaggtgaaaggcagcaacaacatcttcgccattggtgacaatgcatttgctgggttgccaccaaccgcccaagtagcgcaccaggaggccgaatacttggccaagaactttgataaaatggctcagatcccaaatttccagaagaatctatcttcaagaaaggataaaattgatctcctgttcgaggaaaacaactttaagcctttcaagtacaacgatttaggtgccttagcatacctgggaagcgaaagagccattgcaaccataagatccggtaagcggacattctacaccggtggtggcttaatgaccttctacctgtggagaattctgtacctgtccatgattctaagcgcaagaagcagattaaaggtgttcttcgactggattaaactggcatttttcaaaagagacttcttcaaaggattatag

SEQ ID NO: 92 - DNA, 1542 bp, Artificial Sequence
  source: /note="Description of Artificial Sequence: Synthetic polynucleotide"
atgctaagcaagaatctgtatagtaaccggaggttgctcacctcgacgaacaccctcgtccgcttcgcctccaccagatccacaggggtcgaaaactccggagcaggtcccacaagctttaagaccatgaaggtcatcgacccccagcacagcgacaaaccaaacgtgctgatcctgggttcggggtggggagccatttcgtttttaaagcacattgacaccaagaagtacaacgttagcatcatcagccctagaagctatttcttatttacgcctttgttacctagcgccccagtggggaccgtagacgaaaagtcaattatcgagcccatcgttaactttgccctgaagaaaaaggggaacgtcacctactatgaggccgaagccacctctatcaaccccgacaggaataccgtgaccatcaaatcattaagcgccgttagccagctataccaacctgagaaccatctaggcctgcatcaagcagagcctgccgaaattaagtacgattatctgatcagtgctgtgggtgcggaacctaacacatttggtattcctggggtcactgattacggtcatttcctgaaggaaatccccaacagcttggaaataagacggaccttcgccgccaatctggaaaaggccaacttattgccaaagggtgaccccgaaagaagaagactactgagcatcgtggtggtgggtggtggccccactggcgtagaggccgctggtgaactacaggactacgttcaccaggacctgagaaagtttctgcccgcactggccgaagaagtccaaattcacctggtcgaagctctgcccatcgttttgaatatgtttgagaaaaagctttcatcatacgcccagtcacatttagaaaacacttcgatcaaagtgcatctgagaaccgccgtcgccaaggttgaagagaagcaactgttggcaaagaccaaacacgaagacggcaagataaccgaagaaactattccatacggcactttgatttgggccacgggtaacaaggcaagaccggtaatcactgacctgttcaagaaaattcctgagcaaaacagctccaagagaggattggccgtgaatgactttctgcaggtcaaaggcagcaacaacattttcgccattggtgacaatgcctttgctgggttgccaccaaccgcccaagtagcgcaccaagaggccgaatatctggccaagaattttgacaagatggctcagataccaaatttccaaaagaatctatcctccagaaaggataaaattgatctcttgttcgaggagaacaacttcaaacctttcaagtacaacgatctgggcgccttagcatacctgggaagcgaaagggccattgccaccatccgttccggtaagagaaccttctacaccggtggtggcctgatgaccttctacttatggcggattttgtacttgtccatgattctatctgcacgctcgagattaaaggtctttttcgactggattaagctggcctttttcaaaagagactttttcaagggcttatag

SEQ ID NO: 93 - DNA, 1542 bp, Artificial Sequence
  source: /note="Description of Artificial Sequence: Synthetic polynucleotide"
atgctaagcaagaatttgtatagtaacaagaggctgctgaccagcacgaataccctagtgagattcgcttccaccagatccacaggggtcgaaaactccggagcaggtcctacatctttcaagaccatgaaagtcatcgaccctcagcacagcgacaaaccaaacgtgctgatcctgggctcgggctggggcgccatctcgtttttaaagcacatcgacaccaagaagtacaacgtttccatcatctctcctagaagctacttcttattcacgcctttgctgccctctgcccctgttgggaccgtagacgaaaagtcaattattgagcccatcgttaattttgctctgaagaaaaaggggaacgttacctactatgaggcagaagccacctctatcaatcccgacaggaataccgtgaccatcaaatcattaagcgccgttagccagctataccaacctgaaaaccacctggggctgcatcaagcagaacccgctgaaattaagtacgattatttaatcagtgccgtaggtgccgaacccaacacctttggtattcccggggtcactgattacggtcacttcctgaaggaaatccccaactctctggaaatcagaagaactttcgccgccaatctagaaaaggctaacttattgccaaagggtgatcccgagagaagaagactactgtccattgtggtggttggtggtggccccactggtgtagaggccgctggtgaactacaggattatgtgcaccaggacctgagaaagtttctccctgccttggccgaagaagtccaaattcacttggtcgaagctctgcccatcgttttgaatatgttcgagaaaaagctttcaagctacgcgcaatcacatctggaaaacacttccatcaaagtgcatctgagaacggccgtggccaaagttgaagagaagcagctgctggcaaagaccaaacacgaagacggtaaaataaccgaggaaaccattccctacggtaccttgatttgggccacgggtaacaaggcaagacccgtaatcactgaccttttcaagaaaattcctgagcaaaacagctccaagagaggactggcagtgaacgactttttgcaggtcaaaggcagcaacaacattttcgccattggtgacaacgcctttgctgggttgccacctaccgcccaagtagcgcaccaagaagccgagtacttggccaagaatttcgataagatggctcagataccaaatttccagaagaacctatcttcaagaaaggataagattgacctgctgttcgaggagaacaactttaagcctttcaaatacaacgacttaggtgccctggcatacctgggatccgaaagggccattgcaaccatcagaagcggtaagagaaccttctacaccggtggtggcctgatgaccttctacttatggagaattctgtacatgtccatgattctatctgccagaagcagattaaaggtgtttttcgactggattaaattagcattcttcaaaagggacttttttaagggactgtga

SEQ ID NO: 94 - DNA, 1542 bp, Artificial Sequence
  source: /note="Description of Artificial Sequence: Synthetic polynucleotide"
atgctgagcaagaatttgtacagtaacaagaggttgctcaccagcacgaatacgctagtgagattcgcttccaccagatccaccggggtcgaaaactccggagcaggtcccaccagctttaagaccatgaaggtcattgaccctcagcacagcgacaagccaaacgtgctgatactgggttcggggtggggagctatttcgtttttaaagcacatcgacaccaagaagtacaacgtttccatcatcagccctagaagctacttcctgttcacgcctctgttaccctctgccccagttgggacagtagacgaaaagtcaattattgagcccatcgttaatttcgctctcaagaaaaaggggaacgttacctactatgaggcagaggccaccagcatcaatcccgacaggaacaccgtgaccatcaaatcactgagcgccgtttcccagctataccaacctgagaaccatctaggcctgcaccaagcagaacccgctgaaattaagtacgattatttaatcagcgccgtaggcgccgaacctaacacatttggtattcctggggtcactgattacggccacttcctgaaggaaattcccaactctctggaaataagacggaccttcgccgccaacctagagaaggctaacctgttgccaaagggtgatcccgagcggagaaggctactgtccattgtggtggttggtggtggccccactggcgtagaggctgctggcgaactgcaggactatgttcaccaggacctgagaaagtttctccccgcattggccgaagaagtccaaattcacctggtcgaagccctgcccatcgttttgaatatgttcgagaaggagctgtcatcatacgcgcaatcacatttagaaaacacttccatcaaagtacatctgagaacggctgtcgccaaagttgaagaaaagcaattgttggcaaagaccaagcacgaagacggtaaaataaccgaagaaactattccatacggcaccctgatttgggccacgggtaacaaggccagaccggtaatcactgaccttttcaagaaaattcctgagcaaaacagctccaagcggggattggccgtgaatgactttttgcaggtgaaaggcagcaacaacatcttcgccattggtgacaacgcctttgctgggttgcctcctacagcccaagtagcccaccaagaggccgaatatttggccaagaattttgataaaatggctcaaatcccaaatttccagaagaatctatcctccagaaaggataaaattgatctgttgttcgaggagaacaactttaaacctttcaagtacaacgatctgggtgccttagcctacctgggatccgaaagagccattgcaaccatcagatccggtaagcggacattttacaccggtggaggcttaatgaccttctacttatggcggatcctgtacttgagcatgatcctatctgcacgctcgagattaaaggtctttttcgactggattaaactggcctttttcaaaagagacttttttaaaggactgtag

SEQ ID NO: 95 - DNA, 1542 bp, Artificial Sequence
  source: /note="Description of Artificial Sequence: Synthetic polynucleotide"
atgctatcgaagaacctgtacagcaacaagaggctgctcacctcgaccaacaccctagtcagattcgccagcaccagatccaccggggtggaaaacagcggagctggccccacaagcttcaagaccatgaaagtcatcgacccccagcacagcgacaagccaaacgtgctgatcctgggttcgggctggggagccatcagctttctgaagcacattgacaccaagaagtacaacgttagcatcatcagccccagaagctacttcctgttcacgcccttgctgccctctgcaccagtggggaccgtggacgagaagtcaattatcgagcccatcgtgaatttcgccctgaagaaaaagggcaacgtcacctactacgaggccgaggccacctctatcaaccccgaccggaataccgtgaccatcaaaagcttatctgccgtgtcccagctataccagcctgaaaaccacctgggcctgcaccaggcagagcctgccgaaattaagtacgattatctgatcagcgccgtgggcgcggaacccaacacctttggaatccccggggtgactgactacggccacttcctggaggagatccccaacagcctggaaatcagacggacctttgccgccaacctggaaaaggctaacctgttgcctaagggcgaccccgagagaagaagactgctgagcattgtcgtggtgggcggtggccccactggtgtagaagccgctggtgaactgcaggactatgtgcaccaggacctgcggaagttcctccccgcactggccgaggaagtgcaaattcacttggtcgaagccctgcccatcgtgttgaacatgtttgagaagaagctttcaagctacgcccaaagccacctggaaaacacctccatcaaagtgcatctgagaaccgctgtcgccaaggtggaagagaagcaactgctggccaagaccaagcacgaggacggtaagattaccgaggaaaccatcccatacggcaccctgatttgggccacgggtaacaaggccagacccgtgatcactgacctgttcaagaagatccccgagcaaaactcgtccaagcggggactggccgtgaacgactttctgcaggtcaaaggcagcaacaacatcttcgccatcggcgacaatgcctttgctggcttgccacctaccgcccaagtggcccaccaagaggccgaatatttggccaagaatttcgataaaatggctcagatcccaaatttccagaagaacctgtcctcccggaaggataaaatcgacctgttgttcgaggagaacaacttcaagcccttcaagtacaacgatttaggtgccctggcctacctgggcagcgaaagggccattgcaaccatcagaagcggcaagcggacattttacaccggcggtggcttaatgaccttctacctgtggagaattctgtacctgtccatgattctgtctgcccgcagcagattaaaggtctttttcgactggattaagttagcatttttcaagagagacttcttcaagggcctgtga

SEQ ID NO: 96 - DNA, 1542 bp, Artificial Sequence
  source: /note="Description of Artificial Sequence: Synthetic polynucleotide"
atgctaagcaagaacttgtatagcaacaagcggctgctgaccagcacgaacacgatggtgagattcgccagcaccagatccacaggggtcgaaaacagcggagctggccccaccagcttcaagaccatgaaagtcatcgacccccagcacagcgacaaacccaacgtgctgatcctgggttctggctggggagccattagctttttaaagcacatcgacaccaagaagtacaacgtttccatcatctctcccagaagctacttcctgttcacccctctgctgccctctgcacctgtggggacagtggacgaaaagtcaatcatcgagcccatcgtgaatttcgctctgaagaaaaaggggaacgtcacctactacgaggccgaagccaccagcatcaaccccgaccggaacaccgtgaccatcaagagcttaagcgccgtttcccagctgtaccagcctgagaaccacctgggcctgcaccaagcagaacccgccgagattaagtacgattatttaatcagcgctgtgggcgccgagcctaacacctttggtattcctggcgtcactgactacggtcacttcctgaaggagatccccaacagcctggaaatcagacggacctttgccgccaacctggaaaaggctaacctgctgcctaagggcgaccccgagcggagaaggctactgtccatcgtggtcgtgggcggaggccccacaggcgtggaagccgctggtgagctgcaggattatgttcaccaggacctgcggaagtttctccctgccttggccgaggaagtgcagattcacctggtcgaagccctgcccatcgttctgaacatgtttgagaaaaagctgtcatcatacgcgcagagccatttagaaaacacctccatcaaggtgcatctgagaaccgctgtcgccaaagtggaagagaagcagttgctggcaaagaccaagcacgaagacggcaaaataaccgaagaaaccatcccctacggtaccctgatttgggccaccggtaacaaggcaagacccgtaatcactgacctgttcaagaaaatccctgagcaaaacagctccaagagaggcctggcagtgaacgactttctgcaggtgaaaggcagcaacaacattttcgccatcggtgacaatgcatttgccggcttgcctccaacagcccaagtagcgcaccaggaggccgagtacctggccaagaatttcgacaagatggctcagatcccaaatttccaaaagaacctatcctcccggaaggataaaattgatctgctgttcgaggaaaacaacttcaagcctttcaagtacaacgatctgggcgccctggcatacctgggcagcgaaagggccattgccaccatcagatccggcaagcggacattttacaccggcggtggcctgatgaccttctacttatggcggatcctgtacttgtccatgatcctaagcgcacgcagcagattaaaggtcttcttcgactggatcaaactggcattcttcaagagggacttcttcaagggactgtga

SEQ ID NO: 97 - DNA, 1542 bp, Artificial Sequence
  source: /note="Description of Artificial Sequence: Synthetic polynucleotide"
atgctatcgaagaacttgtatagtaacaagaggttgctcaccagcaccaataccctagtgagattcgcctccaccagatccaccggggtggaaaactccggggctggccccacctctttcaagaccatgaaggtcattgaccctcagcacagcgacaaaccaaacgtgctgatactgggctctggctggggcgccattagctttctgaagcacatcgacaccaagaagtacaacgtttccatcatctctcccagaagctacttcttattcacccccttgttaccctctgcaccagttgggaccgtagacgagaagtccatcatcgagcccatcgtgaacttcgccctcaagaaaaagggcaacgtcacctactatgaggcagaagccaccagcatcaaccccgaccggaataccgttaccataaagaacctgtctgccgtttcccagctgtaccagcccgagaaccacctgggcctgcatcaggcagaacccgctgagattaagtacgattacctgatcagtgccgtgggcgcggagcccaacacatttggtatccctggcgtgaccgactacggccacttcctgaaggagattcccaacagcttggaaatcagacggaccttcgccgccaacctggaaaaggctaacctgttgcctaagggcgatcccgagcggagaaggctgctgagcattgtcgtggtgggcggaggccccacaggcgtggaagctgctggcgagctgcaggattatgtgcaccaggacctgcggaagttcctgcccgcattggccgaggaagtccagattcacctggtggaagccctgcccatcgttctgaacatgttcgagaaaaagctgagcagctacgcgcagtcacatctggaaaacacttccatcaaagtgcacctgagaaccgctgtggccaaagtggaagaaaagcaactgttggccaagaccaaacacgaggacggtaagattaccgaagaaaccatcccctacggtaccctgatttgggccacgggcaacaaggccagaccggtaatcactgaccttttcaagaagatccctgagcaaaacagcagcaagcggggattggccgtgaatgactttttgcaggtgaaaggcagcaacaacatcttcgccatcggcgacaatgcctttgccggcctgcctcctacagcccaagtagcccaccaggaagccgaatatttggccaagaacttcgataaaatggctcagatcccaaatttccagaagaacctgtcttcacggaaggataaaatcgacctcctgttcgaggaaaacaacttcaagcccttcaaatacaacgatctgggtgccctggcctacctgggcagcgaaagagccattgccaccataagatccggcaagagaacattttacaccggtggaggcctgatgaccttctacctgtggcggatcctgtacttgtccatgatcctgtctgccagatcgagactgaaggtctttttcgactggatcaagttagccttcttcaagagggacttcttcaaaggcctgtga

SEQ ID NO: 98 - DNA, 1542 bp, Artificial Sequence
  source: /note="Description of Artificial Sequence: Synthetic polynucleotide"
atgctgagcaagaatctgtacagcaacaagcggttgctcaccagcaccaatacgctagtcagattcgcttccaccagatccaccggggtggaaaactccggagctggccctacatctttcaagaccatgaaggtcatcgaccctcagcacagcgacaaacccaacgtgctgatcctgggctctggctggggagccatcagctttctgaagcacatcgacaccaagaagtacaacgtcagcatcatcagccccagaaagtacttcttattcacccctctgctgcccagcgcccctgtgggaaccgtagacgagaagtccattattgagcccatcgttaactttgccctgaagaaaaaggggaacgtcacctactatgaggcagaagccaccagcatcaatcccgaccggaacaccgtgaccatcaagtcactgagcgccgtgagccagctgtaccagcccgagaaccacctggggctgcatcaagccgagcccgctgagattaagtacgactacttaatcagcgccgtgggcgccgagcccaacacctttggtatccctggggtgaccgactacggtcacttcctgaaagaaattcccaactctttggaaataagacggaccttcgccgccaacctagaaaaggccaacctgctgcctaagggtgaccccgaaagaagaaggctgctgtccattgtggtcgtgggtggagggcccactggtgtggaggctgctggtgagctgcaggactacgttcaccaggacctgcggaagtttctgcctgccttggccgaggaagtgcagattcacttggtggaagccctgcccatcgtgttgaacatgttcgagaagaagctgagctcatacgcccagagccacttagaaaacacttccatcaaggtgcacctgagaaccgctgtcgccaaagttgaagagaagcaactgctggcaaagaccaagcacgaggacggcaaaataaccgaggaaactatcccctacggtactttgatttgggccaccggcaacaaggcaagaccggtaatcactgacctgttcaagaaaattcccgagcagaacagcagcaagagaggcctggccgtgaatgactttctgcaggtcaaaggcagcaacaacattttcgccatcggcgacaacgcatttgccggcctgccacctaccgcccaagtagcccaccaagaagccgagtacctggccaagaacttcgataagatggcccaaataccaaatttccagaagaacctgtcctcaagaaaggataaaatcgatctcttgttcgaggaaaacaacttcaaacccttcaagtacaacgatttaggcgccctggcctacctgggctccgaaagggccattgccaccatccgtagcggcaagcggaccttctacaccggcggaggcctgatgaccttctacctgtggagaattttgtacttgtccatgatcctaagcgccagaagcagattaaaggtctttttcgactggatcaaactggcatttttcaagagagacttcttcaagggcttatga

SEQ ID NO: 99 - DNA, 1542 bp, Artificial Sequence
  source: /note="Description of Artificial Sequence: Synthetic polynucleotide"
atgctaagcaagaacttgtacagcaacaagaggctgctgaccagcaccaataccctagtccgcttcgctagcaccagatccaccggggtggaaaacagcggagcaggtcctacaagcttcaagaccatgaaggtcatcgacccccagcacagcgacaaacccaacgtgctgatcctgggttcggggtggggcgctatcagctttctgaagcacattgacaccaagaagtacaacgtttccatcatctctcccagaaagtacttcttattcacgcccttgttacctagcgcacctgttggaaccgtggacgaaaagtccatcattgagcccatcgtgaatttcgccctgaagaaaaaggggaacgtcacctactatgaggcagaggccacctctatcaaccccgaccggaacaccgtgaccataaaaagcttaagcgccgtgtcccagctgtaccaacccgaaaaccacctaggcctgcaccaggccgaacccgctgaaattaagtacgactacctgatcagcgccgtgggcgcggagcccaacacatttggtatccctggcgtgaccgactacggtcacttcctgaaagaaatccccaacagcttggaaatcagaagaaccttcgccgccaacctggagaaggctaacctgctgccaaagggcgaccccgagagaagaaggctactgtccatcgtggtggttggcggaggccccacaggcgtggaagccgctggcgaactacaggactacgtgcaccaggacctgcggaagtttctgcccgccctggccgaagaagtgcaaattcacctggtcgaagccctgcccatcgtgctgaatatgttcgagaagaagcttagcagctacgcccagtcacacttagaaaacacttcgatcaaagtgcacctgagaaccgctgtggccaaggttgaagagaagcagttgttggccaagaccaagcacgaggacggcaagattaccgaggaaaccatcccctacggtaccctgatttgggccacgggtaacaaggcaagacccgtgatcactgaccttttcaagaaaatccctgagcaaaactcgagcaagcggggcttggccgtgaacgactttctgcaggtgaaaggcagcaacaacattttcgccatcggtgacaacgcatttgctgggctgccacctacagcccaggtggcgcaccaagaagccgagtacctggccaagaacttcgacaaaatggcccagatacccaatttccagaagaatctatcctccagaaaggataagattgatctgctgttcgaggaaaacaacttcaaacctttcaagtacaacgatttaggcgccttagcctacctgggctccgaaagagccattgccaccatacgtagcggtaagagaaccttttacaccggtggaggcctgatgaccttctacctgtggagaatcttgtacctgagcatgatcctaagcgcccgcagcagactgaaggtgttcttcgactggattaaattagcctttttcaagagggacttcttcaaaggcctgtga

SEQ ID NO: 100 - DNA, 1542 bp, Artificial Sequence
  source: /note="Description of Artificial Sequence: Synthetic polynucleotide"
atgctgagcaagaacctgtacagcaacaagcggctgctcaccagcacgaataccctcgtcagattcgccagcaccagatccacaggggtcgaaaacagcggagctggtcccaccagcttcaagaccatgaaggtcatcgacccccagcacagcgacaaacccaacgtgctgatcctgggctcggggtggggcgccattagctttctgaagcacattgacaccaagaagtacaacgtctccatcatctctcctagaagctacttcttatttacccccctgttacccagcgccccagttgggaccgtggacgaaaagtccatcatcgagcccatcgtgaacttcgccctgaagaaaaagggcaacgtcacctactacgaggccgaagccacctctatcaaccccgaccggaacaccgttaccatcaaatcactgtctgccgtgtcccagctgtaccagcctgaaaaccatctgggcctgcatcaggcagaacccgccgaaattaagtacgactacttaatcagcgccgtgggcgcggagcccaacacctttggtattcctggcgtcaccgactacggtcacttcttcaaggagatccccaacagcctggaaatccggagaactttcgccgccaacctggaaaaggccaacttattgccaaagggtgatcccgaacggagaagactgctgagcatcgtggtggtgggcggaggccctacaggcgtagaggctgctggtgaactacaggactatgtgcaccaggacctgagaaagtttctccctgccctggccgaggaagtccaaattcacctggtcgaagccctgcccatcgtgctgaacatgttcgagaagaagctttcaagctacgcccaatcacatttagaaaacacctccatcaaggtacacctgagaaccgctgtggccaaggtggaagagaagcaactgttggccaagaccaagcacgaagacggcaaaattaccgaagaaaccatcccctacggtactttgatttgggccaccggcaacaaggccagaccggtgatcaccgaccttttcaagaagatccctgagcagaactcgtccaagcggggcttggcagtgaacgacttcttgcaggtgaaaggcagcaacaacatcttcgccatcggcgacaacgcatttgccgggctgcctcctaccgcccaagtagcccaccaggaagccgagtatttggccaagaattttgacaagatggcccagataccaaatttccagaagaatctatcctcaagaaaggataagattgatctgttgttcgaggaaaacaacttcaagcctttcaaatacaacgacttaggcgccctggcatacctgggcagcgaaagagccattgccaccatcagaagcggcaagagaacattctacaccggcggaggcctgatgaccttctacctgtggcggattttgtacctgtccatgattctgtctgcccgcagcagactgaaggtgttcttcgactggattaaactggcattcttcaagagggacttcttcaagggattatag

SEQ ID NO: 101 - DNA, 1542 bp, Artificial Sequence
  source: /note="Description of Artificial Sequence: Synthetic polynucleotide"
atgctaagcaagaacctgtacagtaacaagaggttgctgaccagcaccaatacgctagtccgcttcgccagcaccagatccaccggggtggaaaacagcggagctggccccacaagcttcaagaccatgaaggtcattgaccctcagcacagcgacaagccaaacgtgctgatactgggttctggctggggcgctatttcgtttctgaagcacattgacaccaagaagtacaacgtcagcatcatctctcccagaagctatttcctgttcacccccctgttaccctctgccccagttggaaccgtggacgagaagtccatcatcgagcccatcgtgaacttcgccctgaagaaaaaggggaacgttacctactacgaggccgaagccaccagcatcaaccccgaccggaacaccgtgaccataaaatcattatctgccgttagccagctgtaccagcctgaaaaccacctggggctgcatcaggccgagcctgctgagattaagtacgattacctgatcagtgccgtgggcgcggaacccaacacctttggaatccccggggtgaccgactacggccatttcctgaaagaaatccccaactctctggaaatccggagaaccttcgccgccaacctggaagaggccaacctgctgccaaagggcgaccccgaaagaagaagactgctgagcatcgtcgtggtgggcggaggccccactggcgtggaagctgctggcgaactgcaggattacgttcaccaggacctgcggaagttcctgcctgccctggccgaggaagtccaaattcacttggtcgaagctctgcccatcgttttgaatatgttcgagaaaaagctgtcaagctacgcccagtcacacctggaaaacacctcgatcaaggtgcacctgagaacggccgtcgccaaggtggaagaaaagcaactgctggcaaagaccaaacacgaagacggcaagattaccgaagaaaccatcccatacggtaccttgatttgggccacgggcaacaaggccagaccggtaatcactgaccttttcaagaagattcctgagcagaacagctccaagagaggcctggcagtgaatgacttcctgcaggtcaaaggcagcaacaacatcttcgccattggcgacaatgcatttgctggcctgcctccaacagcccaagtggcccaccaggaagccgagtacctggccaagaactttgacaagatggcccagataccaaatttccaaaagaatctgtcctccagaaaggataagatcgacctgttgttcgaggaaaacaactttaagcccttcaagtacaacgacctgggtgccttagcctacctgggctccgaaagagccattgccaccataagatccggtaagcggaccttttacaccggtggaggcctgatgaccttctacctgtggcggattctgtacctgagcatgattctgagcgcacgctcgagactgaaggtcttcttcgactggatcaaactggcatttttcaagagagacttcttcaagggcctgtag

SEQ ID NO: 102 - DNA, 1542 bp, Artificial Sequence
  source: /note="Description of Artificial Sequence: Synthetic polynucleotide"
atgctaagcaagaatctgtatagcaacaagaggctgctgacctcgacgaacacgatggtcagattcgctagcaccagatccaccggcgtggaaaacagcggggcaggccccacaagcttcaagaccatgaaagtcattgaccctcagcacagcgacaagccaaacgtgctgatcctgggctctggctggggagccatcagctttctgaagcacatcgacaccaagaagtacaacgtctccatcatctctcccagaagctacttcctgttcacgcccttgctgccctctgcacctgtgggaaccgtagacgaaaagtccattatcgagcccatcgtgaacttcgccctgaagaaaaagggcaacgtcacctactacgaggccgaggccacctctatcaaccccgacaggaacaccgttaccatcaaaagcctgagcgccgtgagccagctgtaccagcccgagaaccatctgggcctgcaccaggcagagcccgccgagattaagtacgattacttaatcagtgccgtgggtgccgaacccaacacctttggaattcccggcgtgaccgactacggtcatttcctgaaagagatccccaactctctggaaatcagaagaactttcgccgccaacctagaaaaggctaacctgttgcctaagggtgatcccgaaagaagaagactactgtccatcgtggtggttggcggagggcccactggcgtggaggctgctggtgagctgcaggactacgttcaccaggacctgagaaagttcctgcctgccttggccgaagaagtgcaaattcacttggtcgaagccctgcccatcgtgctgaacatgttcgagaaaaagctgtcaagctacgcccagtcacacctggaaaacacctccatcaaagtacatctgagaacggccgtcgccaaggtggaagagaagcagctgttggcaaagaccaagcacgaggacggcaaaataaccgaagaaaccattccctacggtaccctgatttgggccaccggcaacaaggccagaccggtgatcaccgaccttttcaagaagatccccgagcagaacagcagcaagagaggcctggcagtgaatgacttcctgcaggtcaaaggcagcaacaacatcttcgccatcggtgacaacgcctttgccggcctgccacctacagcccaagtggcgcaccaagaggccgagtacctggccaagaattttgataagatggcccagatcccaaatttccagaagaatctatcctcaagaaaggataagatcgatctcctgttcgaggagaacaacttcaaacccttcaagtacaacgatctgggcgccctggcatacctgggcagcgaaagggccattgcaaccataagatccggcaagagaacattctacaccggcggtggcttaatgaccttctacttatggcggattctgtacctgagcatgatcctaagcgcacgcagcagactgaaggtgtttttcgactggattaaactggccttcttcaaaagggacttttttaagggcttatga

SEQ ID NO: 103 - DNA, 1542 bp, Artificial Sequence
  source: /note="Description of Artificial Sequence: Synthetic polynucleotide"
atgctgtcgaagaacttgtatagcaacaagaggctgctgaccagcacgaacaccctcgtgagattcgccagcaccagatccaccggcgtcgaaaactccggagctggtcccacctctttcaagaccatgaaggtcatcgaccctcagcacagcgacaagcccaacgtgctgatcctgggttctggctggggagccattagctttttaaagcacatcgacaccaagaagtacaacgtctccatcatctctcccagaagctatttcttattcacgcccctgctgcctagcgcacctgtggggaccgtggacgagaagtcaattatcgagcccatcgtgaattttgctctcaagaaaaagggcaacgttacctactatgaggccgaggccacctctatcaaccccgaccggaacaccgtgaccataaagaacctgagcgccgtgagccagctgtaccaacccgaaaaccacctgggcctgcaccaggcagaacccgccgagattaagtacgattatttaatcagcgccgtaggcgccgagcccaacacctttggtattcccggcgtgaccgactacggtcatttcctgaaagagattcccaacagcctggaaatccggcggacttttgccgccaatctagaaaaggctaacctgctgcctaagggtgaccccgagcggagaaggctgctgagcattgtcgtcgtgggtggagggcctactggcgtggaagccgctggcgaactgcaggattacgttcaccaggacctgagaaagttcctgcccgccctggccgaggaagtccaaattcacttggtggaagctctgcccatcgtgctgaacatgttcgagaaaaagctgtcatcatacgcccagtcacacttagaaaacacttccatcaaagtacacctgagaaccgctgtggccaaggttgaagaaaagcaattgctggcaaagaccaagcacgaggacggcaaaataaccgaagaaaccattccatacggtaccttgatttgggccacgggcaacaaggccagaccggtgatcactgacctgttcaagaagatccctgagcagaactcgtccaagagaggcttggccgtgaacgacttcttgcaggtcaaaggcagcaacaacattttcgccattggtgacaacgcctttgccgggctgcctccaaccgcccaggtggcccaccaagaagccgagtacctggccaagaactttgacaagatggctcagatacccaatttccagaagaacctgtcctcaagaaaggataagatcgacctgctgttcgaggagaacaacttcaaacctttcaagtacaacgatctgggcgccttagcctacctgggcagcgaaagggccattgcaaccatccgttccggcaagagaaccttctacaccggcggaggcttaatgaccttctacctgtggagaattctgtacttgagcatgatcctgagcgccagaagcagactgaaggtgttcttcgactggatcaagttagcatttttcaagagggacttcttcaagggactgtga

SEQ ID NO: 104 - DNA, 1542 bp, Artificial Sequence
  source: /note="Description of Artificial Sequence: Synthetic polynucleotide"
atgctgtcgaagaatctgtatagcaacaagaggttgctgaccagcaccaataccctcgtgagattcgctagcaccagatccaccggcgtcgaaaacagcggagcaggccctaccagcttcaagaccatgaaggtcatcgaccctcagcacagcgacaaaccaaacgtgctgatactgggctcgggctggggagccattagctttctgaagcacatcgacaccaagaagtacaacgtttccatcatcagccctagaagctacttcctgtttacccccctgttaccctctgcaccagtgggaaccgtagacgaaaagtccatcattgagcccatcgtgaatttcgctctgaagaaaaaggggaacgtcacctactatgaggcagaggccacctctatcaaccccgaccggaataccgtgaccatcaagagcctgtctgccgttagccagctataccagcctgagaaccacctgggcctgcaccaggccgagcccgccgagattaagtacgactacctgatcagtgccgtgggcgccgagcccaacacctttggtatccccggcgtgactgattacggccatttcctgaaggaaatccccaactctctggaaatcagaagaaccttcgccgccaacctggagaaggccaacttattgcctaagggcgatcccgagagaagaagactactgagcattgtcgtcgttggcggtggccccacaggtgtggaggccgctggtgaactgcaggattatgtgcaccaggacctgcggaagtttctgcccgcattggccgaggaagtgcaaattcacctggtggaagccctgcccatcgtgctgaacatgttcgagaagaagcttagcagctacgcccagagccatctggaaaacacctcgatcaaggtacatctgagaaccgctgtcgccaaggtggaagagaagcagttgttggcaaagaccaagcacgaggacggcaagattaccgaggaaactatcccctacggcactctgatttgggccacgggcaacaaggcaagaccggtgatcaccgacctgttcaagaagatccccgagcaaaacagctccaagcggggattggcagtgaacgacttcctgcaggtcgagggcagcaacaacattttcgccattggtgacaacgcctttgccggcctgccaccaacagcccaggtggcgcaccaggaagccgagtacctggccaagaacttcgataaaatggcccagataccaaatttccagaagaacctgtcctcaagaaaggataagatcgacctgctgttcgaggaaaacaacttcaagcccttcaagtacaacgatctgggtgccctggcatacctgggctccgaaagggccattgcaaccatacgttccggtaagcggaccttctacaccggcggaggcctgatgaccttctacctgtggcggatcctgtacctgagcatgattctgtctgcaagaagcagactgaaggtgtttttcgactggattaaattagcattcttcaaaagagacttctttaagggattatga

SEQ ID NO: 105 - DNA, 1542 bp, Artificial Sequence
  source: /note="Description of Artificial Sequence: Synthetic polynucleotide"
atgctatcgaagaacttgtatagtaacaagcggttgctcaccagcaccaacacgctcgtgcgcttcgccagcaccagatccaccggcgtggaaaactccggggctggtcccacctctttcaagaccatgaaagtcatcgaccctcagcacagcgacaagcccaacgtgctgatactgggctctggctggggagccattagctttctgaagcacattgacaccaagaagtacaacgttagcatcatctctcctagaagctacttcttatttacgcccttgctgccctctgcacctgttgggacagtggacgagaagtcaattatcgagcccatcgtgaacttcgctctgaagaaaaagggcaacgtcacctactatgaggccgaggccacctctatcaaccccgaccggaacaccgtgaccatcaaaagcctgtctgccgtttcccagctataccaacccgagaaccacctgggcctgcaccaggcagagcccgccgaaattaagtacgactacctgatcagtgctgtaggtgccgagcctaacacatttggaattcccggggtgaccgattacggccatttcctgaaggagatccccaactctttggaaatccggcggacttttgccgccaacctagaaaaggccaacttactgcctaagggcgaccccgaaagaagaagactgctgagcatcgtcgtggtgggtggagggcctacaggcgtggaagctgctggtgaactgcaggactatgttcaccaggacctgcggaagtttctgcctgcactggccgaggaagtgcaaattcacctggtggaagctctgcccatcgttttgaacatgttcgagaagaagctgagcagctacgcccaaagccacctggaaaacacctccatcaaagtacatctgagaacggccgtcgccaaggtggaagaaaagcagctgctggcaaagaccaaacacgaagacggtaagattaccgaggaaactattccctacggtaccctgatttgggccaccggtaacaaggccagacccgtgatcactgacctgttcaagaagattcccgagcaaaactcgagcaagcggggcttggccgtgaatgacttcctgcaggtgaaaggcagcaacaacattttcgccatcggcgacaacgcatttagcggcctgcctcctaccgcccaggtggcccaccaagaggccgagtatctggccaagaacttcgacaaaatggcccagataccaaatttccagaagaatctgtcctcccggaaggataagatcgatctgttgttcgaggaaaacaacttcaagcccttcaagtacaacgacctgggcgccctggcctacctgggaagcgaaagggccattgcaaccataagaagcggtaagcggaccttctacaccggcggaggcttaatgaccttctacttatggcggattttgtacttgagcatgatcctgtctgcaagatcgagactgaaggtcttcttcgactggatcaaactggccttcttcaagagggacttcttcaaaggcctgtga

SEQ ID NO: 106 - DNA, 1542 bp, Artificial Sequence
  source: /note="Description of Artificial Sequence: Synthetic polynucleotide"
atgctaagcaagaacctgtacagcaacaagaggctgctgacctcgaccaacaccatggtcagattcgccagcaccagatccacaggcgtggaaaactccggagctggtcctaccagcttcaagaccatgaaagtcattgacccccagcacagcgacaaaccaaacgtgctgatcctgggctctgggtggggcgccatctcgtttttaaagcacatcgacaccaagaagtacaacgttagcatcatcagccccagaagctatttcctgttcacccctttgctgccttctgcaccagtgggaaccgtggacgagaagtccattatcgagcccatcgtgaattttgctctcaagaaaaagggcaacgttacctactatgaggccgaggccaccagcatcaatcccgacaggaacaccgtgaccatcaagagcctgagcgccgtgagccagctgtaccagcctgagaaccatctaggcctgcaccaagcagagcctgccgaaattaagtacgattatctgatcagtgccgtgggcgcggagcccaacacatttggtatccccggggtcaccgattacggtcatttcctgaaagagattcccaactctttggaaatcagacggaccttcgccgccaacctagagaaggccaacctgttgcctaagggtgatcccgagcggagaaggctgctgtccatcgtggtggtgggtggtggccctacaggcgtggaagccgctggtgagctacaggactacgtgcaccaggacctgagaaagttcctgcctgccttggccgaggaagtgcagattcacctggtggaagccctgcccatcgtgttgaatatgttcgagaagaagctgagctcatacgcgcaaagccacctggaaaacacttccatcaaggtacacctgagaaccgctgtcgccaaagtggaagagaagcagttgctggcaaagaccaagcacgaggacggtaaaattaccgaggaaaccattccctacggcaccctgatttgggccaccggtaacaaggccagacccgtaatcactgacctgttcaagaagatccctgagcagaacagcagcaagagaggcttggccgtgaatgacttcctgcaggtcaaaggcagcaacaacatcttcgccattggcgacaacgcatttgccggcctgccacctacagcccaggtagcccaccaagaagccgaatatttggccaagaattttgacaaaatggcccagataccaaatttccagaagaacctgtcttcccggaaggataagatcgatctgttgttcgaggaaaacaacttcaagcccttcaagtacaacgatttaggcgccttagcatacctgggcagcgaaagggccattgccaccatccgttccggtaagagaaccttctacaccggcggtggcctgatgaccttctacctgtggagaatcttgtacctgagcatgatcctgagcgcacgcagcagactgaaggtgttcttcgactggatcaaactggccttcttcaaaagggacttcttcaagggactgtga

SEQ ID NO: 107 - DNA, 1542 bp, Artificial Sequence
  source: /note="Description of Artificial Sequence: Synthetic polynucleotide"
atgctgagcaagaacctgtacagtaacaagaggctgctgaccagcacgaacacgctcgtgcgcttcgctagcaccagatccacaggggtcgaaaacagcggggcaggccccacctcttttaagaccatgaaggtcatcgaccctcagcacagcgacaaacccaacgtgctgatcctgggctctggctggggcgccatcagctttctgaagcacattgacaccaagaagtacaacgtttccatcatcagccccagaaagtacttcctgttcacgcccctgttacctagcgcacctgttggaaccgtggacgagaagtcaatcatcgagcccatcgtgaacttcgctctcaagaaaaaggggaacgtcacctactacgaggccgaagccaccagcatcaatcccgacaggaataccgttaccatcaaaagcctgtctgccgtttcccagctgtaccagcctgagaaccatctggggctgcatcaagccgaacctgctgaaattaagtacgactacctgatcagtgccgtaggtgcggaacccaacacatttggaattcctggcgtcaccgactacggtcacttcctgaaagaaatccccaactctctggaaatcagaagaaccttcgccgccaatctagaaaaggccaacctgttgcctaagggcgaccccgaacggagaaggctactgagcattgtggtcgtgggtggtggccccacaggtgtggaggccgctggcgagctacaggactatgtgcaccaggacctgcggaagttcctgcccgccctggccgaagaagtgcaaattcacttggtggaagctctgcccatcgttttgaatatgtttgagaagaagctgtcatcatacgcgcaatcacatctggaaaacacctcgatcaaagtacacctgagaaccgccgtggccaaggtggaagagaagcagctgctggcaaagaccaaacacgaggacggcaagattaccgaggaaactattccatacggcactctgatttgggccacgggcaacaaggcaagaccggtgatcaccgacctgttcaagaaaatccccgagcagaacagcagcaagagaggcttggccgtgaacgactttttgcaggtcaaaggcagcaacaacatcttcgccatcggcgacaacgcatttgccggcctgccacctaccgcccaagtggcccaccaagaagccgagtacttggccaagaatttcgacaagatggcccagataccaaatttccagaagaatctgtcctcccggaaggataagatcgacctgttgttcgaggaaaacaacttcaagcccttcaagtacaacgacttaggtgccctggcatacctgggcagcgaaagagccattgccaccatacgtagcggtaagcggaccttctacaccggcggtggcctgatgaccttctacttatggagaatcttgtacctgagcatgattctgagcgcacgcagcagattaaaggtgttcttcgactggatcaaactggcatttttcaaaagagacttcttcaaaggcctgtga

SEQ ID NO: 108 - DNA, 1542 bp, Artificial Sequence
  source: /note="Description of Artificial Sequence: Synthetic polynucleotide"
atgctgtcgaagaacctgtacagcaaccggaggctgctgacctcgaccaataccctagtccgcttcgctagcaccagatccaccggggtggaaaactccggggctggtcccacctcttttaagaccatgaaggtcatcgacccccagcacagcgacaagcccaacgtgctgatactgggctctggctggggcgccatttcgtttctgaagcacattgacaccaagaagtacaacgtcagcatcatctctcccagaagctacttcctgtttacgcccctgctgccctctgcccctgtgggaacagtagacgagaagtccatcattgagcccatcgtgaacttcgccctgaagaaaaaggggaacgttacctactacgaggcagaggccaccagcatcaaccccgaccggaacaccgtgaccatcaaaagcttaagcgccgtgtcccagctataccagcctgagaaccatctgggcctgcaccaagccgagcctgctgaaattaagtacgactatctgatcagcgccgtgggcgcggagcctaacacctttggaatccctggcgtcaccgattacggtcacttcctgaaggaaatccccaacagcttggaaatacggcggacctttgccgccaacctagagaaggccaacctgttgcctaagggcgaccccgaaagaagaaggctactgagcatcgtggtcgttggtggtgggcccacaggcgtggaggctgctggtgagctgcaggattatgtgcaccaggacctgcggaagtttctgcccgccttggccgaggaagtccaaattcacctggtggaagccctgcccatcgtgttgaatatgttcgagaagaagctgagcagctacgcgcaatcacacttagaaaacacttccatcaaagtacatctgagaaccgctgtcgccaaggtggaagagaagcagttgctggcaaagaccaagcacgaggacggcaagataaccgaggaaactatcccctacggtaccctgatttgggccacgggcaacaaggcaagaccggtaatcactgacctgttcaagaagattcccgagcagaactcgtccaagagaggactggccgtgaacgactttctgcaggtgaaaggcagcaacaacatcttcgccatcggtgacaatgcatttgccgggctgccacctaccgcccaagtagcccaccaggaggccgagtatctggccaagaacttcgacaagatggcccagatccccaatttccaaaagaacctgtcttcaagaaaggataaaatcgacctgctgttcgaggaaaacaacttcaagcctttcaagtacaacgacctgggtgccctggcctacctgggaagcgaaagagccattgccaccatacgtagcggtaagcggaccttctacaccggcggaggcttaatgaccttctacctgtggcggattttgtacctgagcatgatcctgtctgccagaagcagactgaaggtctttttcgactggatcaaactggccttcttcaaaagagacttctttaaaggcttatga

SEQ ID NO: 109 - DNA, 1542 bp, Artificial Sequence
  source: /note="Description of Artificial Sequence: Synthetic polynucleotide"
atgctgagcaagaatttgtacagcaacaagcggctgctcaccagcacgaacaccctagtgcgcttcgccagcaccagatccaccggggtcgaaaacagcggagctggccccaccagcttcaagaccatgaaagtcatcgaccctcagcacagcgacaaaccaaacgtgctgatcctgggctcggggtggggagctatctcgtttctgaagcacatcgacaccaagaagtacaacgtcagcatcatcagccccagaagctacttcttattcacccctctgttacccagcgccccagttggaaccgtggacgagaagtcaattatcgagcccatcgtgaactttgccctgaagaaaaagggcaacgtcacctactatgaggccgaggccacctctatcaaccccgacaggaataccgtgaccatcaagtcactgtctgccgttagccagctgtaccaacccgagaaccatctaggcctgcaccaggccgagcccgccgaaattaagtacgactacctgatcagcgccgtgggcgccgagcccaacacatttggaattcctggggtgaccgactacggccatttcctgaaggaaatccccaactctttggaaatccggagaaccttcgccgccaatctggaaaaggccaacctgttgcctaagggcgaccccgaacggagaaggctactgtccattgtggtcgttggtggtggccccacaggcgtggaagctgctggtgagctacaggactacgttcaccaggacctgcggaagttcttccccgccctggccgaagaagtgcaaattcacctggtggaagctctgcccatcgtgttgaacatgttcgagaagaagctgagcagctacgcgcaaagccacctggaaaacacctcgatcaaggtacacctgagaaccgccgtggccaaagtggaagagaagcaattgttggccaagaccaaacacgaagacggtaagattaccgaggaaactatcccatacggtaccttgatttgggccacgggtaacaaggcaagacccgtaatcactgaccttttcaagaaaattcccgagcaaaactcgagcaagcggggcctggcagtgaacgacttcttgcaggtgaaaggcagcaacaacattttcgccattggtgacaacgcatttgccgggctgccacctaccgcccaggtggcccaccaagaggccgagtacttggccaagaactttgacaaaatggcccagataccaaatttccaaaagaatctgtcttcacggaaggataaaatcgacctgctgttcgaggagaacaacttcaagcccttcaagtacaacgatctgggtgccttagcctacctgggctccgaaagagccattgccaccatcagaagcggtaagagaaccttctacaccggtggtggcctgatgaccttctacctgtggcggattttgtacctgagcatgatcctaagcgcaagaagcagattaaaggtgtttttcgactggattaagttagcctttttcaagagggacttcttcaagggcctgtga

SEQ ID NO: 110 - DNA, 1542 bp, Artificial Sequence
  source: /note="Description of Artificial Sequence: Synthetic polynucleotide"
atgctgagcaagaatctgtacagtaacaagcggctgctcaccagcaccaataccctagtgcgcttcgcctccaccagatccacaggcgtcgaaaacagcggggctggccccacctctttcaagaccatgaaagtcatcgaccctcagcacagcgacaagccaaacgtgctgatcctgggttctggctggggagccatttcgtttctgaagcacattgacaccaagaagtacaacgtctccatcatctctcctagaaagtatttcctgttcacgcccttgctgcccagcgccccagtgggaaccgtggacgagaagtcaattattgagcccatcgttaatttcgctctcaagaaaaagggcaacgtcacctactatgaggccgaagccacctctatcaaccccgaccggaacaccgttaccatcaagtcactgagcgccgtttcccagctgtaccagcccgagaaccacctaggcctgcaccaggccgagcctgccgagattaagtacgactacctgatcagcgctgtaggcgcggaacctaacacatttggtattcccggggtcaccgactacggtcacttcctgaaagagatccccaacagcttggaaatacggcggacctttgccgccaacctagaaaaggccaacctgctgccaaagggcgatcccgaacggagaaggctgctgagcatcgtggtggtgggtggaggccccacaggcgtggaagccgctggcgaactgcaggactacgtgcaccaggacctgcggaagtttctccccgcactggccgaggaagtgcagattcacttggtcgaagccctgcccatcgttctgaacatgttcgagaagaagctgagcagctacgcgcagtcacatctggaaaacacttccatcaaggtacatctgagaacggccgtggccaaggttgaagagaagcagttgctggcaaagaccaaacacgaggacggcaaaataaccgaagaaaccatcccctacggtactttgatttgggccaccggcaacaaggccagacccgtgatcaccgaccttttcaagaagatccccgagcagaacagctccaagagaggcctggcagtgaacgacttcctgcaggtgaaaggcagcaacaacattttcgccatcggcgacaacgcatttgccggcctgcctcctaccgcccaagtggcgcaccaggaagccgagtacctggccaagaattttgataaaatggcccaaataccaaatttccagaagaatctatcttcccggaaggataaaattgatctgctgttcgaggaaaacaacttcaagcctttcaaatacaacgacttaggtgccctggcatacctgggaagcgaaagagccattgcaaccatcagatccggtaagcggaccttttacaccggcggaggcctgatgaccttctacctgtggcggattttgtacttgtccatgattctgtctgccagaagcagactgaaggtcttcttcgactggatcaagttagcattcttcaaaagggactttttcaagggcttatga

SEQ ID NO: 111 - DNA, 1542 bp, Artificial Sequence
  source: /note="Description of Artificial Sequence: Synthetic polynucleotide"
atgctatcgaagaacctgtatagcaaccggcggctgctgacctcgaccaacaccctcgtcagattcgccagcaccagatccacaggcgtggaaaacagcggagctggtcccacaagcttcaagaccatgaaggtcattgaccctcagcacagcgacaaaccaaacgtgctgatcctgggctctggctggggagctatcagctttctgaagcacatcgacaccaagaagtacaacgtctccatcatcagccccagaagctacttcctgtttacccccctgctgcctagcgcacctgtgggaacagtagacgaaaagtccatcattgagcccatcgttaatttcgctctgaagaaaaagggcaacgtcacctactatgaggcagaagccaccagcatcaatcccgacaggaataccgtgaccataaaaagcttaagcgccgtttcccagctataccagcctgaaaaccacctgggcctgcaccaggccgaacccgccgaaattaagtacgactatctgatcagcgccgtgggtgcggaacctaacacctttggaatccctggggtgactgactacggtcatttcctgaaagaaatccccaacagcttggaaatccggagaactttcgccgccaacctggaaaaggccaacctgctgcctaagggcgaccccgagcggagaaggctgctgagcatcgtcgtggtgggcggtggccctacaggcgtggaggctgctggtgaactgcaggattatgtgcaccaggacctgagaaagtttctccccgccttggccgaggaagtccaaattcacctggtggaagctctgcccatcgttctgaacatgttcgagaagaagcttagcagctacgcccaaagccacttagaaaacacttcgatcaaagtgcacctgagaaccgctgtggccaaagtggaagagaagcagttgctggccaagaccaaacacgaagacggtaagataaccgaagaaaccatcccatacggtaccctgatttgggccaccggcaacaaggcaagacccgtaatcaccgacctgttcaagaaaattcccgagcagaacagctccaagagaggcctggcagtgaacgacttcttgcaggtcaaaggcagcaacaacattttcgccatcggtgacaacgcatttgccgggttgcctcctacagcccaagtggcccaccaggaggccgagtacctggccaagaacttcgacaagatggctcagatccccaatttccagaagaacctatcctcacggaaggataaaattgatctgctgttcgaggaaaacaacttcaagcccttcaagtacaacgatttaggtgccctggcctacctgggcagcgaaagagccattgccaccatcagaagcggtaagcggacattctacaccggcggtggcttaatgaccttctacctgtggagaatcctgtacctgagcatgatcctgtctgccagaagcagactgaaggtgttcttcgactggattaaactggcctttttcaagagagactttttcaagggattatag

SEQ ID NO: 112 - DNA, 1542 bp, Artificial Sequence
  source: /note="Description of Artificial Sequence: Synthetic polynucleotide"
atgctgtcgaagaacttgtatagtaacaagcggttgctcacctcgacgaacacgctcgtgcgcttcgctagcaccagatccacaggggtggaaaacagcggagcaggtcctaccagcttcaagaccatgaaggtcattgaccctcagcacagcgacaagccaaacgtgctgatactgggctcgggctggggcgccatctcgtttttaaagcacatcgacaccaagaagtacaacgtcagcatcatcagccctagaagctatttcctgttcacgcccctgctgcctagcgccccagttggaaccgtggacgagaagtcaatcatcgagcccatcgtgaacttcgctctgaagaaaaagggcaacgtcacctactacgaggcagaagccacctctatcaaccccgaccggaataccgtgaccatcaagagcttatctgccgtttcccagctataccagcccgaaaaccacctggggctgcatcaggccgaacctgccgagattaagtacgattacctgatcagtgctgtgggcgccgaacccaacacctttggaatccccggggtgactgactacggtcatttcctgaaagaaatccccaacagcctggaaatacggcggaccttcgccgccaacctggagaaggccaacttactgccaaagggtgaccccgaacggagaaggctactgagcattgtggtcgtgggcggtggccctactggcgtggaggccgctggtgaactgcaggattacgtgcaccaggacctgagaaagtttctgcccgcattggccgaggaagtgcagattcacctggtcgaagccctgcccatcgtgctgaacatgttcgagaaaaagctgagctcatacgcccaaagccacttagaaaacacctcgatcaaggtgcacctgagaaccgctgtggccaaggttgaagaaaagcagctgctggccaagaccaagcacgaggacggcaagataaccgaggaaactattccatacggcaccctgatttgggccaccggcaacaaggccagacccgtgatcactgaccttttcaagaagatccccgagcagaactcgagcaagagaggcttggccgtgaacgactttctgcaggtgaaaggcagcaacaacattttcgccatcggcgacaatgcctttgctggcctgccacctaccgcccaggtagcgcaccaggaagccgaatatctggccaagaatttcgataagatggctcagatccccaatttccagaagaatctatcttcccggaaggataaaatcgacctcttgttcgaggagaacaacttcaagcccttcaagtacaacgatctgggcgccctggcatacctgggctccgaaagagccattgccaccatcagaagcggcaagagaaccttttacaccggtggaggcctgatgaccttctacctgtggagaattctgtacttgagcatgattctgagcgcccgcagcagactgaaggtcttcttcgactggatcaagctggcctttttcaaaagggacttcttcgagggcttatag

SEQ ID NO: 113 - DNA, 1542 bp, Artificial Sequence
  source: /note="Description of Artificial Sequence: Synthetic polynucleotide"
atgctatcgaagaatctgtacagcaacaagcggctgctgaccagcaccaacaccctagtccgcttcgccagcaccagatccacaggggtggaaaacagcggggcaggccctacatctttcaagaccatgaaagtcatcgacccccagcacagcgacaaacccaacgtgctgatactgggttcgggctggggagccatctcgtttctgaagcacatcgacaccaagaagtacaacgtcagcatcatcagccctagaaagtatttcttattcacgcctttgctgccctctgccccagttgggaccgtggacgagaagtccatcatcgagcccatcgtgaatttcgctctgaagaaaaagggcaacgtcacctactatgaggcagaggccacctctatcaaccccgacaggaataccgttaccatcaaaagcctgtctgccgtttcccagctgtaccagcctgagaaccacctaggcctgcatcaggccgagcccgccgagattaagtacgactacttaatcagcgctgtaggtgccgagcccaacacctttggtattcccggggtgaccgattacggccacttcctgaaggaaatccccaacagcttggaaatacggcggacctttgccgccaatctagagaaggctaacttattgcctaagggcgatcccgagcggagaagactgctgtccatcgtcgtggttggtggtggccccacaggtgtagaggctgctggtgagctacaggattacgtgcaccaggacctgagaaagttcctccctgccctggccgaggaagtgcagattcacttggtggaagccctgcccatcgtgttgaatatgttcgagaagaagcttagcagctacgcccagtcacacctggaaaacacttccatcaaggtacacctgagaacggccgtcgccaaagtggaagagaagcagttgctggccaagaccaaacacgaggacggcaagattaccgaagaaactattccctacggtaccctgatttgggccaccggcaacaaggcaagacccgtgatcaccgacctgttcaagaagatccccgagcagaacagctccaagcggggcctggcagtgaacgacttcctgcaggtcaaaggcagcaacaacatcttcgccatcggcgacaatgcctttgctgggctgccaccaacagcccaggtagcgcaccaggaggccgagtatctggccaagaattttgacaagatggcccagatccccaatttccagaagaatctgtcttcccggaaggataaaattgacctgctgttcgaggaaaacaacttcaaacccttcaaatacaacgacttaggcgccctggcctacctgggaagcgaaagagccattgccaccatcagatccggcaagcggaccttctacaccggcggtggcttaatgaccttctacctgtggcggattctgtacttgtccatgatcctgagcgcacgctcgagattaaaggtgtttttcgactggatcaagctggccttcttcaagagagacttctttaagggcctgtga

SEQ ID NO: 114 - DNA, 1542 bp, Artificial Sequence
  source: /note="Description of Artificial Sequence: Synthetic polynucleotide"
atgctaagcaagaatctgtatagcaacaagcggctgctcaccagcaccaacacgctcgtcagattcgccagcaccagatccaccggggtcgaaaacagcggggctggccctacaagcttcaagaccatgaaggtcattgaccctcagcacagcgacaaacccaacgtgctgatactgggctcggggtggggcgccatttcgtttttaaagcacatcgacaccaagaagtacaacgtctccatcatcagccctagaagctatttcctgttcacgcccctgctgccctctgcccctgtgggaacagtagacgaaaagtccatcatcgagcccatcgtgaattttgccctcaagaaaaagggcaacgtcacctactacgaggcagaggccacctctatcaaccccgaccggaataccgtgaccataaagagcctgtctgccgtttcccagctgtaccaacctgagaaccacctggggctgcaccaagccgaacctgctgagattaagtacgactatttaatcagtgctgtgggtgcggagcccaacacctttggtattcctggcgtgactgactacggtcacttcctgaaagagatccccaacagcttggaaatcagaagaaccttcgccgccaacctggaaaaggccaacctgctgccaaagggcgatcccgagcggagaagactactgagcatcgtggtggtgggcggaggccccactggcgtggaggccgctggtgagctacaggactacgtgcaccaggacctgagaaagttcctgcccgccctggccgaggaagtgcagattcacctggtcgaagctctgcccatcgtgctgaatatgttcgagaagaagctgagctcatacgcccagagccacttagaaaacacctcgatcaaggtacatctgagaacggccgtggccaaggtggaagaaaagcagctgttggcaaagaccaagcacgaggacggtaaaataaccgaggaaactattccctacggcaccctgatttgggccaccggcaacaaggccagacccgtgatcactgacctgttcaagaagatccccgagcagaacagctccaagagaggactggccgtgaacgacttcttgcaggtcaaaggcagcaacaacattttcgccattggtgacaatgcctttgccggcctgcctcctacagcccaggtggcccaccaggaagccgagtacttggccaagaacttcgataagatggctcaaatcccaaatttccagaagaatctgtcttccagaaaggataagattgatctcctgttcgaggaaaacaactttaagcctttcaagtacaacgatttaggcgccctggcatacctgggaagcgaaagagccattgcaaccataagatccggtaagagaacattctacaccggtggaggcctgatgaccttctacttatggcggatcttgtacctgtccatgatcctgtctgcccgctcgagactgaaggtgttcttcgactggatcaaaatggcatttttcaagagagacttctttaagggcctgtag

SEQ ID NO: 115 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgagattcgcctccaccagatccaccggcgtcgaaaacagcggggctggccccaccagcttcaagaccatgaaagtcatcgacccccagcacagcgacaagcccaacgtgctgatcctgggctctggctggggcgccatcagctttctgaagcacatcgacaccaagaagtacaacgtcagcatcatcagccccagaagctatttcctgcacacccccctgctgcccagcgcacctgtgggaacagtggacgagaagtccatcatcgagcccatcgtgaacttcgccctgaagaaaaagggcaacgtcacctactacgaggccgaggccaccagcatcaatcccgaccggaataccgtgaccatcaagagcctgagcgccgtgtcccagctgtaccagcccgagaaccacctgggcctgcaccaggccgagcctgccgagattaagtacgactacctgatcagtgccgtgggtgccgagcccaacacctttggaatccccggcgtgaccgactacggccacttcctgaaagagatccccaacagcttggaaatccggcggaccttcgccgccaacctggaaaaggccaacctgctgcctaagggtgaccccgagcggagaaggctgctgagcatcgtggtcgtgggcggtgggcccacaggtgtggaagccgctggcgagctgcaggactacgttcaccaggacctgcggaagttcctgcccgccctggccgaagaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgttggccaagaccaagcacgaggacggcaagattaccgaagaaaccatcccctacggcaccctgatttgggccaccggcaacaaggccagacccgtgatcactgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtagcccaccaggaagccgaatacctggccaagaactttgacaagatggcccaaatccccaatttccagaagaacctgtcctcccggaaggataagatcgacctgctgttcgaggaaaacaacttcaagcccttcaaatacaacgacctgggcgccctggcctacctgggcagcgaaagagccattgccaccatcagaagcggcaagcggaccttttacaccggcggaggcctgatgaccttctacctgtggcggatcctgtacctgagcatgatcctgagcgcccgcagcagactgaaggtgttcttcgactggattaagctggccttcttcaagagggacttcttcaagggcctgtga

SEQ ID NO: 116 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggggtcgaaaacagcggagctggccccaccagcttcaagaccatgaaggtcatcgacccccagcacagcgacaagccaaacgtgctgatcctgggctcgggctggggcgccattagctttctgaagcacatcgacaccaagaagtacaacgtcagcatcatcagccccagaagctacttcctgttcacccccctgctgcccagcgcccctgtgggaaccgtggacgagaagtccatcattgagcccatcgtgaacttcgccctgaagaaaaagggcaacgtcacctactacgaggccgaagccaccagcatcaaccccgaccggaacaccgttaccataaagagcctgagcgccgtgtcccagctgtaccagcccgagaaccacctgggcctgcaccaggccgagcccgccgagattaagtacgactacctgatcagcgccgtgggcgccgaacccaacacctttggaatccccggcgtgaccgactacggccacttcctgaaagagatccccaacagcttggaaatccggcggaccttcgccgccaacctggaaaaggccaacctgctgcctaagggcgaccccgagcggagaaggctgctgagcatcgtggtcgtgggtggaggccccacaggcgtggaagctgctggtgagctgcaggactacgtgcaccaggacctgcggaagttcctgcccgccctggccgaggaagtccagattcacctggtggaagccctgcccatcgtgttgaacatgttcgagaagaagctgagcagctacgcgcagagccatctggaaaacacctccatcaaggtgcacctgagaaccgccgtggccaaggtggaagagaagcagctgctggccaagaccaagcacgaggacggcaagataaccgaggaaaccatcccctacggcaccttgatttgggccaccggcaacaaggcaagacccgtgatcaccgacctgttcaagaagatccctgagcaaaacagcagcaagcggggactggccgtgaacgactttctgcaggtcaaaggcagcaacaacatcttcgccatcggcgacaatgcctttagcggcctgcctcctacagcccaagtggcccaccaggaagccgagtacctggccaagaacttcgacaagatggctcagatccccaatttccagaagaacctgtcctcccggaaggataagatcgacctgctgttcgaggaaaacaacttcaagcccttcaagtacaacgatctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaaaagggacttcttcaagggcctgtga

SEQ ID NO: 117 - DNA, 1542 bp, Artificial Sequence
  source: /note="Description of Artificial Sequence: Synthetic polynucleotide"
atgctaagcaagaacctgtacagcaacaagcggctgctgaccagcaccaacaccctcgtgcgcttcgccagcaccagatccacaggcgtcgaaaacagcggggctggccccacaagcttcaagaccatgaaggtcatcgacccccagcacagcgacaagccaaacgtgctgatcctgggctctggctggggagccatcagctttttaaagcacatcgacaccaagaagtacaacgtcagcatcatcagccccagaagctacttcctgttcacccccctgctgcccagcgcccctgtggggaccgtggacgagaagtccattatcgagcccatcgtgaacttcgctctgaagaaaaagggcaacgttacctactacgaggcagaggccaccagcatcaaccccgaccggaacaccgtgaccatcaagagcctgagcgccgtgtcccagctgtaccagcccgagaaccacctgggcctgcaccaagccgagcccgccgaaattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggattacgtgcaccaggacctgcggaagttcctgcccgccctggccgaggaagtgcagattcacctggtggaagccctgcccatcgtgctgaacatgttcgagaagaagctttcaagctacgcccagtcacacttagaaaacacctccatcaaggtgcacctgagaaccgccgtggccaaggtggaagagaagcagctgctggccaagaccaagcacgaggacggcaagattaccgaggaaaccatcccatacggcactctgatttgggccaccggcaacaaggcaagacccgtgatcactgacctgttcaagaagatccccgagcagaactcgagcaagcggggcctggccgtgaacgacttcctgcaggtcaaaggcagcaacaacatcttcgccatcggtgacaacgcctttgccggcctgcctcctacagcccaggtggcccaccaggaagccgagtacctggccaagaacttcgacaagatggcccagatccccaatttccagaagaacctgtcttcccggaaggataagatcgacctgctgttcgaggaaaacaacttcaagcccttcaagtacaacgacctgggcgccctggcatacctgggcagcgaaagagccattgccaccatcagaagcggcaagcggaccttctacaccggcggaggcttaatgaccttctacctgtggcggatcttgtacctgagcatgatcctgagcgcccgcagcagactgaaggtgttcttcgactggatcaagctggccttcttcaagagggactttttcaagggcctgtga

SEQ ID NO: 118 - DNA, 1542 bp, Artificial Sequence
  source: /note="Description of Artificial Sequence: Synthetic polynucleotide"
atgctaagcaagaacctgtacagcaacaagcggctgctgaccagcaccaacaccctcgtgcgcttcgcctccaccagatccaccggcgtcgaaaacagcggggctggccccacctctttcaagaccatgaaggtcatcgacccccagcacagcgacaagcccaacgtgctgatcctgggctctggctggggagccatcagctttctgaagcacattgacaccaagaagtacaacgtcagcatcatctctcccagaagctacttcctgtttacccccctgctgcccagcgcacctgtgggaaccgtggacgagaagtccatcatcgagcccatcgtgaactttgccctgaagaaaaagggcaacgttacctactacgaggccgaggccaccagcatcaaccccgaccggaacaccgtgaccatcaagagcctgagcgccgtgtcccagctataccagcccgagaaccacctgggcctgcaccaggccgagcccgccgagattaagtacgactacctgatcagcgccgtgggcgccgagcccaacacctttggaatccctggcgtgaccgactacggccacttcctggaggagatccccaacagcctggaaatccggcggacctttgccgccaacctggaaaaggccaacctgctgcctaagggcgatcccgagcggagaaggctgctgagcatcgtggtcgtgggcggaggccccacaggcgtggaagctgctggcgagctgcaggattacgtgcaccaggacctgcggaagttcctgcccgccctggccgaggaagtgcagattcacctggtggaagccctgcccatcgtgctgaacatgttcgagaagaagctgagcagctacgcccagagccatctggaaaacacctccatcaaagtgcacctgagaaccgccgtggccaaggtggaagagaagcagctgctggcaaagaccaagcacgaagacggcaagattaccgaggaaaccatcccctacggcactctgatttgggccaccggcaacaaggccagacccgtgatcaccgacctgttcaagaagatccccgagcagaacagcagcaagcggggcctggcagtgaacgacttcctgcaggtcaaaggcagcaacaacatcttcgccatcggcgacaacgcctttgccggcctgccacctacagcccaagtggcccaccaagaagccgagtacctggccaagaacttcgacaagatggcccaaatccccaatttccagaagaacctgtcctcccggaaggataagatcgatctgctgttcgaggaaaacaacttcaaacccttcaagtacaacgacctgggcgccctggcatacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaaaagggacttcttcaagggcctgtga

SEQ ID NO: 119 - DNA, 1542 bp, Artificial Sequence
  source: /note="Description of Artificial Sequence: Synthetic polynucleotide"
atgctgagcaagaacctgtacagcaacaagcggctgctcaccagcaccaacaccctcgtgcgcttcgccagcaccagatccaccggcgtcgaaaacagcggggctggccccaccagctttaagaccatgaaggtcatcgacccccagcacagcgacaagcccaacgtgctgatcctgggctctggctggggagccatcagctttctgaagcacatcgacaccaagaagtacaacgtcagcatcatcagccccagaagctacttcctgttcacccccctgctgcccagcgcccctgttggaaccgtggacgagaagtccatcatcgagcccatcgtgaatttcgccctgaagaaaaaggggaacgtcacctactacgaggccgaggccaccagcatcaaccccgaccggaacaccgtgaccatcaagaacctgagcgccgtttcccagctgtaccagcccgaaaaccacctgggcctgcaccaggccgaacctgctgagattaagtacgactacctgatcagcgccgtgggcgccgagcccaacacctttggtatccccggcgtgactgactacggccacttcctgaaagagattcccaacagcctggaaatccggcggaccttcgccgccaacctagaaaaggccaacctgctgcctaagggcgaccccgagcggagaaggctgctgagcatcgtggtcgtgggcggaggccccacaggcgtggaagccgctggcgagctgcaggactacgtgcaccaggacctgcggaagttcctgcccgccctggccgaggaagtgcagattcacctggtggaagccctgcccatcgtgctgaacatgttcgagaagaagctgagctcatacgcccagagccacctggaaaacacctccatcaaggtgcacctgagaaccgccgtggccaaggtggaagaaaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggactggccgtgaacgacttcttgcaggtcaaaggcagcaacaacatcttcgccatcggcgacaacgcctttgccggcctgcctcctacagcccaggtggcccaccaggaagccgagtacctggccaagaacttcgacaagatggcccaaatccccaatttccagaagaacctgtcctccagaaaggataagatcgacctgctgttcgaggaaaacaacttcaagcccttcaagtacaacgacctgggcgccctggcctacctgggctccgaaagagccattgccaccataagaagcggcaagcggacattttacaccggcggaggcctgatgaccttctacctgtggcggatcttgtacctgagcatgatcctgagcgcacgcagcagactgaaggtgttcttcgactggatcaagttagccttcttcaagagggacttcttcaagggcctgtga

SEQ ID NO: 120 - DNA, 1542 bp, Artificial Sequence
  source: /note="Description of Artificial Sequence: Synthetic polynucleotide"
atgctgagcaagaacctgtacagcaacaagcggttgctgaccagcaccaacaccctcgtgcgcttcgccagcaccagatccaccggcgtcgaaaacagcggggctggccccaccagcttcaagaccatgaaggtcatcgacccccagcacagcgacaaacccaacgtgctgatcctgggctctggctggggcgccatcagctttttaaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccatctgggcctgcaccaggccgaacccgccgagattaagtacgactacctgatcagcgccgtgggcgccgagcccaacacctttggaatccccggcgtgaccgactacggccacttcctgaaagagatccccaacagcctggaaatccggagaacctttgccgccaacctggaaaaggccaacctgttgccaaagggcgaccccgagcggagaaggctactgagcatcgtggtcgtgggcggaggccccacaggcgtggaagccgctggcgagctgcaggactacgttcaccaggacctgcggaagttcctgcccgccctggccgaagaagtgcagattcacttggtggaagccctgcccatcgtgctgaacatgttcgagaagaagctgagcagctacgcccagtcacacctggaaaacacttccatcaaggtgcacctgagaaccgccgtggccaaggtggaagagaagcagctgctggccaagaccaagcacgaggacggcaagataaccgaggaaaccatcccctacggcaccctgatttgggccaccggcaacaaggccagaccggtgatcaccgacctgttcaagaagatccccgagcagaacagcagcaagcggggcctggccgtgaacgactttctgcaggtcaaaggcagcaacaacatcttcgccatcggcgacaacgcatttgccggcctgcctcctacagcccaagtagcccaccaggaagccgagtacctggccaagaacttcgacaagatggctcagatccccaatttccagaagaacctgtcctcccggaaggataagatcgatctgctgttcgaggaaaacaacttcaagcccttcaagtacaacgatctgggcgccctggcctacctgggcagcgaaagggccattgcaaccatcagaagcggcaagcggaccttctacaccggcggaggcttaatgaccttctacctgtggcggatcctgtacctgagcatgatcctgagcgcccgcagcagactgaaggtgttcttcgactggatcaagctggccttcttcaagagggacttcttcaagggactgtga

SEQ ID NO: 121 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtggaaaacagcggggctggccctaccagcttcaagaccatgaaagtcatcgacccccagcacagcgacaagcccaacgtgctgatcctgggctctggctggggagctatcagctttctgaagcacatcgacaccaagaagtacaacgtcagcatcatcagccccagaagctacttcctgtttacccccctgctgcccagcgcacctgtgggaaccgtggacgaaaagtccatcatcgagcccatcgtgaacttcgccctgaagaaaaagggcaacgtcacctactacgaggcagaggccaccagcatcaaccccgaccggaacaccgtgaccataaagagcctgagcgccgtttcccagctgtaccagcccgagaaccacctaggcctgcaccaggccgagcccgccgaaattaagtacgactacctgatcagcgccgtgggtgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgcactggccgaggaagtgcagattcacctggtggaagccctgcccatcgtgctgaacatgttcgagaagaagctgagcagctacgcccagagccacctggaaaacacctccatcaaggtgcatctgagaaccgccgtggccaaggtggaagaaaagcagctgttggccaagaccaagcacgaggacggcaagattaccgaggaaaccatcccctacggcaccctgatttgggccaccggcaacaaggccagaccggtgatcaccgacctgttcaagaaaattcccgagcagaacagcagcaagcggggcctggccgtgaacgacttcctgcaggtcaaaggcagcaacaacatcttcgccatcggcgacaacgcctttgccggcctgccacctacagcccaggtggcccaccaggaagccgaatacctggccaagaacttcgacaagatggcccagatacccaatttccagaagaacctgtcctcccggaaggataagatcgacctgctgttcgaggaaaacaacttcaagcccttcaagtacaacgacctgggtgccctggcctacctgggctccgaaagagccattgccaccatcagaagcggcaagagaaccttctacaccggcggaggcctgatgaccttctacctgtggcggatcctgtacctgagcatgatcctgagcgcccgcagcagactgaaggtgttcttcgactggatcaagctggccttcttcaagagggactttttcaaaggcctgtga

SEQ ID NO: 122 - DNA, 1542 bp, Artificial Sequence
  source: /note="Description of Artificial Sequence: Synthetic polynucleotide"
atgctgagcaagaacctgtacagcaacaagcggttgctgaccagcaccaacaccctcgtgagattcgccagcaccagatccaccggcgtcgaaaacagcggggctggccccaccagcttcaagaccatgaaggtcatcgacccccagcacagcgacaagcccaacgtgctgatcctgggctcgggctggggcgccatcagctttctgaagcacatcgacaccaagaagtacaacgtcagcatcatcagccctagaagctatttcctgttcacccccctgctgcccagcgcccctgtgggaaccgtggacgagaagtccatcatcgagcccatcgttaatttcgccctgaagaaaaagggcaacgtcacctactacgaggccgaggccaccagcatcaaccccgaccggaacaccgtgaccatcaagagcctgagcgccgtgagccagctgtaccagcccgagaaccacctgggcctgcaccaggccgagcccgccgagattaagtacgactacctgatcagcgctgtgggcgccgagcccaacacctttggaatccccggcgtgaccgactacggccatttcctgaaagagatccccaacagcctggaaatccggcggaccttcgccgccaacctggaagaggccaacttactgcctaagggtgaccccgagcggagaaggctgctgagcatcgtggtcgttggcggtggccccacaggcgtagaagctgctggcgagctgcaggactacgtgcaccaggacctgcggaagttcctgcccgccctggccgaggaagtgcagattcacctggtggaagccctgcccatcgtgctgaacatgttcgagaagaagcttagcagctacgcccagagccacctggaaaacacctccatcaaggtgcatctgagaacggccgtggccaaggtggaagagaagcagctgctggccaagaccaagcacgaggacggcaagattaccgaggaaaccatcccctacggcaccctgatttgggccaccggcaacaaggccagaccggtgatcaccgacctgttcaagaagatccccgagcagaacagcagcaagcggggcctggccgtgaacgactttttgcaggtcaaaggcagcaacaacatcttcgccatcggcgacaacgcctttgccggcctgcctcctacagcccaggtggcccaccaggaagccgagtacctggccaagaatttcgacaagatggcccagatccccaatttccagaagaacctgtcttcccggaaggataagatcgacctgctgttcgaggaaaacaacttcaaacccttcaagtacaacgatctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagattaaaggtgttcttcgactggatcaagttagccttcttcaagagagacttcttcaagggcctgtag

SEQ ID NO: 123 - DNA, 1542 bp, Artificial Sequence
  source: /note="Description of Artificial Sequence: Synthetic polynucleotide"
atgctgagcaagaacctgtacagcaacaagcggctgctgaccagcaccaacacgctcgtccgcttcgccagcaccagatccaccggcgtcgaaaacagcggggctggccccacctctttcaagaccatgaaggtcatcgacccccagcacagcgacaagcccaacgtgctgatcctgggctctggctggggcgccatcagctttctgaagcacatcgacaccaagaagtacaacgtctccatcatcagccccagaagctacttcctgttcacccccttgctgcccagcgcccctgtggggaccgtggacgaaaagtccatcatcgagcccatcgttaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgactacttaatcagcgccgtgggcgcggagcccaacacctttggaatccctggcgtgactgactacggccacttcctgaaagaaatccccaacagcctggaaatccggcggaccttcgccgccaacctggaaaaggccaacctgctgcctaagggtgaccccgagcggagaaggctgctgagcatcgtggtcgtgggcggaggccccacaggcgtggaggctgctggcgagctgcaggactacgtgcaccaggacctgcggaagttcctgcccgccctggccgaggaagtccagattcacctggtggaagccctgcccatcgtgctgaacatgtttgagaagaagctgagcagctacgcccaaagccacctggaaaacacctccatcaaagtgcacctgagaaccgctgtggccaaagtggaagagaagcagttgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggtgacaatgcctttgccggcctgcctcctacagcccaggtggcccaccaggaagccgagtacctggccaagaacttcgacaagatggcccagatacccaatttccagaagaacctgtcctcccggaaggataagatcgatctgctgttcgaggaaaacaacttcaagcccttcaagtacaacgatctgggcgccctggcctacctgggcagcgaaagagccattgccaccatcagaagcggcaagcggaccttctacaccggcggaggcctgatgaccttctacctgtggcggatcctgtacttgagcatgatcctgagcgcccgcagcagactgaaggtgttcttcgactggatcaagctggcattcttcaagagggacttcttcaagggcctgtga

SEQ ID NO: 124 - DNA, 1542 bp, Artificial Sequence
  source: /note="Description of Artificial Sequence: Synthetic polynucleotide"
atgctaagcaagaacctgtacagcaacaagcggctgctgaccagcacgaacaccctcgtgagattcgccagcaccagatccaccggcgtcgaaaacagcggggctggccccaccagcttcaagaccatgaaggtcatcgacccccagcacagcgacaaacccaacgtgctgatcctgggctctggctggggcgctatcagctttttaaagcacatcgacaccaagaagtacaacgtcagcatcatctctcctagaagctatttcctgttcacccccctgctgcccagcgcccctgtgggaaccgtggacgagaagtccatcatcgagcccatcgtgaacttcgccctgaagaaaaaggggaacgtcacctactacgaggccgaggccaccagcatcaaccccgaccggaacaccgtgaccatcaagagcctgagcgccgtgtcccagctataccagcccgagaaccacctaggcctgcaccaggccgagcccgccgagattaagtacgattacctgatcagcgccgtgggcgccgaacccaacacctttggaatccctggcgtgaccgactacggccacttcctgaaagagatccccaacagcttggaaatccggcggaccttcgccgccaatctggaaaaggccaacctgctgccaaagggcgaccccgagcggagaaggctgctgagcatcgtggtcgtgggcggagggcccacaggcgtggaagccgctggcgagctgcaggactacgtgcaccaggacctgcggaagttcctgcccgccctggccgaggaagtgcagattcacttggtggaagccctgcccatcgtgctgaacatgttcgagaagaagctgagcagctacgcccagagccacctggaaaacacctcgatcaaggtgcacctgagaaccgccgtggccaaggtggaagagaagcagttgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaatgcatttgccggcctgcctccaacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgatctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagatggccttcttcaagagggacttcttcaagggcctgtag

SEQ ID NO: 125 - DNA, 1542 bp, Artificial Sequence
  source: /note="Description of Artificial Sequence: Synthetic polynucleotide"
atgctgagcaagaacctgtatagcaacaagcggctgctgaccagcaccaacaccctcgtgcgcttcgccagcaccagatccaccggcgtcgaaaacagcggggctggccctaccagctttaagaccatgaaggtcatcgacccccagcacagcgacaagcccaacgtgctgatcctgggctctgggtggggcgctatcagctttctgaagcacatcgacaccaagaagtacaacgtcagcatcatcagccccagaagctatttcctgcacacccccctgctgcccagcgcccctgtgggaacagtggacgagaagtcaatcatcgagcccatcgtgaacttcgccctcaagaaaaagggcaacgtcacctactacgaggccgaggccaccagcatcaaccccgaccggaacaccgtgaccatcaagagcctgagcgccgtgagccagctgtaccagcccgagaaccatctgggcctgcaccaggccgaacccgccgagattaagtacgactacctgatcagcgccgtgggcgccgagcccaacacctttggtatccccggcgtgaccgactacggccatttcctgaaagaaatccccaacagcctggaaatccggcggaccttcgccgccaacctggaaaaggccaacctgctgcctaagggcgaccccgagcggagaaggctgctgagcatcgtggtggtgggcggaggccccacaggcgtggaagctgctggcgagctgcaggactacgtgcaccaggacctgcggaagttcctgcccgccctggccgaggaagtgcaaattcacttggtggaagctctgcccatcgtgctgaacatgttcgagaagaagctgagctcatacgcccagagccacctggaaaacacctccatcaaggtgcacctgagaaccgccgtggccaaggtggaagagaagcagctgctggccaagaccaagcacgaggacggtaagattaccgaggaaaccatcccctacggcaccctgatttgggccaccggtaacaaggccagacccgtgatcaccgacctgttcaagaagatccccgagcagaacagcagcaagcggggcctggcagtgaacgacttcctgcaggtcaaaggcagcaacaacatcttcgccatcggcgacaacgcatttgctgggctgcctcctacagcccaggtggcccaccaagaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcatacctgggcagcgaaagagccattgcaaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 126 - DNA, 1542 bp, Artificial Sequence
  source: /note="Description of Artificial Sequence: Synthetic polynucleotide"
atgctgtcgaagaacctgtacagcaacaagcggctgctgaccagcaccaacaccctcgtgcgcttcgccagcaccagatccaccggcgtcgaaaacagcggggctggccccaccagcttcaagaccatgaaggtcatcgaccctcagcacagcgacaagcccaacgtgctgatcctgggctctggctggggcgccatctcgtttctgaagcacatcgacaccaagaagtacaacgtcagcatcatcagccccagaaagtacttcctgttcacgcccttgctgcccagcgcccctgtgggaaccgtggacgagaagtccattatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccaacccgaaaaccatctgggcctgcaccaggccgagcccgccgagattaagtacgactacctgatcagcgccgtgggcgccgagcccaacacatttggtatccccggcgtgaccgactacggccacttcctgaaagaaatccccaacagcctggaaatccggcggaccttcgccgccaacctggagaaggccaacctgctgcctaagggcgatcccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagcttagcagctacgcccagagccacctggaaaacacctccatcaaagtgcacctgagaaccgccgtggccaaggtggaagagaagcagctgctggcaaagaccaagcacgaggacggcaagattaccgaggaaactatcccctacggcaccctgatttgggccaccggtaacaaggccagacccgtgatcaccgacctgttcaagaagattcccgagcagaacagctccaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcacggaaggataagatcgacctgctgttcgaggaaaacaacttcaagcccttcaagtacaacgacctgggcgccctggcctacctgggcagcgaaagagccattgccaccatcagaagcggcaagagaaccttctacaccggcggaggcctgatgaccttctacctgtggagaatcctgtacctgagcatgatcctgagcgccagaagcagactgaaggtgttcttcgactggattaagttagccttcttcaagagagacttctttaagggcctgtga

SEQ ID NO: 127 - DNA, 1542 bp, Artificial Sequence
  source: /note="Description of Artificial Sequence: Synthetic polynucleotide"
atgctgagcaagaacctgtacagcaacaagcggctgctgaccagcaccaataccctagtgcgcttcgccagcaccagatccaccggcgtcgaaaacagcggagctggccccaccagctttaagaccatgaaggtcatcgacccccagcacagcgacaaacccaacgtgctgatcctgggctctggctggggagccatcagctttctgaagcacattgacaccaagaagtacaacgtcagcatcatcagccccagaagctacttcctgttcacccccctgctgcccagcgccccagttggaaccgtggacgagaagtccatcatcgagcccatcgtgaacttcgccctgaagaaaaagggcaacgtcacctactacgaggccgaggccaccagcatcaaccccgacaggaacaccgtgaccatcaagtcactgtctgccgtgtcccagctgtaccaacctgagaaccacctgggcctgcaccaggccgagcccgccgagattaagtacgactacctgatcagcgccgtgggcgccgagcccaacacctttggaatccccggcgtgaccgactacggccacttcttcaaagagattcccaacagcctggaaatccggcggaccttcgccgccaacctggaaaaggctaacctgctgcctaagggcgaccccgagcggagaagactgctgagcatcgtggtcgtgggcggaggccccacaggcgtggaagctgctggcgagctgcaggactacgtgcaccaggacctgcggaagttcctgcccgccctggccgaggaagtgcagattcacctggtcgaagccctgcccatcgtgctgaacatgtttgagaagaagctgagctcatacgcgcagagccacctggaaaacacctccatcaaggtacacctgagaaccgccgtggccaaggtggaagagaagcagctgctggccaagaccaagcacgaggacggcaagattaccgaggaaaccatcccctacggtaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctccaacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacttaggcgccctggcctacctgggcagcgaaagagccattgccaccatcagaagcggcaagcggaccttttacaccggcggaggcctgatgaccttctacctgtggagaatcctgtacctgagcatgatcctgagcgcacgctcgagactgaaggtgttcttcgactggatcaagctggccttcttcaagagggacttcttcaagggcctgtga

SEQ ID NO: 128 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtccgcttcgccagcaccagatccaccggcgtcgaaaacagcggggcaggccccaccagcttcaagaccatgaaggtcatcgacccccagcacagcgacaagcccaacgtgctgatcctgggctctgggtggggcgccatcagctttctgaagcacatcgacaccaagaagtacaacgtcagcatcatcagccctagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccacctctatcaaccccgaccggaataccgtgaccatcaagagcttaagcgccgtgtcccagctgtaccagcccgaaaaccacctgggcctgcaccaggccgaacccgccgagattaagtacgattacttaatcagcgccgtgggtgccgaacccaacacctttggaatccccggcgtcaccgattacggccacttcctgaaagagatccccaactctctggaaatacggagaaccttcgccgccaacctggaaaaggccaacctgctgcctaagggcgaccccgagcggagaaggctgctgagcatcgtggtcgtgggcggtggccccacaggcgtggaagctgctggcgagctgcaggactacgtgcaccaggacctgcggaagttcctgcccgccctggccgaggaagtgcagattcacctggtggaagccctgcccatcgttctgaacatgttcgagaagaagctgagcagctacgcccagagccacctggaaaacacctccatcaaggtgcacctgagaaccgccgtggccaaggtggaagagaagcagctgctggcaaagaccaagcacgaggacggcaagattaccgaggaaaccatcccctacggcaccctgatttgggccaccggcaacaaggccagacccgtgatcaccgacctgttcaagaaaatccccgagcaaaacagcagcaagcggggcctggccgtgaacgacttcctgcaggtcaaaggcagcaacaacatcttcgccatcggcgacaacgcctttgccggcctgcctcctacagcccaggtggcccaccaagaagccgagtacctggccaagaacttcgacaagatggcccagatccccaatttccagaagaacctgtcctcccggaaggataagatcgacctgctgttcgaggagaacaacttcaagcccttcaagtacaacgacctgggcgccctggcctacctgggaagcgaaagagccattgccaccatcagaagcggcaagcggaccttctacaccggcggaggcctgatgaccttctacctgtggagaatcctgtacctgagcatgatcctgagcgcccgcagcagactgaaggtgttcttcgactggatcaaattagccttcttcaagagggacttcttcaagggcctgtga

SEQ ID NO: 129 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgaccctcagcacagcgacaaacccaacgtgctgatcctgggctctggctggggagccatcagctttctgaagcacatcgacaccaagaagtacaacgtcagcatcatcagccccagaagctacttcctgttcacgcccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcctgagaaccacctgggcctgcaccaggccgagcccgccgagattaagtacgactacctgatcagcgccgtgggcgccgagcccaacacctttggaatccccggcgtcaccgactacggccacttcctgaaagagatccccaacagcctggaaatccggcggaccttcgccgccaacctggaaaaggccaacctgctgcctaagggtgatcccgagcggagaaggctgctgagcatcgtggtcgtgggcggagggcctacaggcgtggaagctgctggcgagctgcaggactacgtgcaccaggacctgcggaagttcctgcccgccctggccgaggaagtgcaaattcacctggtggaagccctgcccatcgtgttgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagattcccgagcagaacagctccaagagaggactggccgtgaacgacttcttgcaggtcaaaggcagcaacaacatcttcgccatcggcgacaacgcctttgccggcctgccacctacagcccaggtagcccaccaggaagccgaatacctggccaagaatttcgacaagatggctcagatccccaatttccagaagaatctgtcctcccggaaggataagatcgacctgctgttcgaggaaaacaacttcaagcccttcaagtacaacgacctgggcgccctggcctacctgggctccgaaagagccattgccaccatcagaagcggcaagagaaccttctacaccggcggaggcctgatgaccttctacctgtggcggatcttgtacctgagcatgatcctgagcgcccgcagcagactgaaggtgttcttcgactggattaagctggccttcttcaaaagggacttcttcaaaggcctgtga

SEQ ID NO: 130 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgagattcgccagcaccagatccaccggcgtcgaaaacagcggggctggccctaccagcttcaagaccatgaaggtcatcgacccccagcacagcgacaagccaaacgtgctgatcctgggctctggctggggcgccatcagctttctgaagcacatcgacaccaagaagtacaacgtcagcatcatcagccccagaagctacttcctgtttacccccctgctgcccagcgcccctgtggggaccgtggacgagaagtccatcatcgagcccatcgtgaacttcgctctgaagaaaaagggcaacgtcacctactacgaggccgaggccaccagcatcaaccccgaccggaacaccgtgaccatcaagagcctgagcgccgtgagccagctgtaccagcccgagaaccacctgggcctgcaccaggccgagcccgctgaaattaagtacgactacctgatcagtgccgtgggcgccgaacccaacacctttggtatccccggggtgaccgactacggccacttcctgaaagagatccccaacagcctggaaatccggcggaccttcgccgccaacctggaaaaggccaacctgctgcctaagggcgaccccgagagaagaagactgctgagcatcgtggtcgtgggcggaggccccacaggcgtggaagctgctggcgagctgcaggattacgtgcaccaggacctgcggaagttcctccccgccctggccgaggaagtgcagattcacctggtggaagccctgcccatcgttctgaacatgttcgagaagaagctgtcaagctacgcccagagccacctggaaaacacctccatcaaggtgcacctgagaaccgccgtggccaaagtggaagagaagcagctgttggccaagaccaagcacgaggacggcaagattaccgaggaaaccatcccctacggcactctgatttgggccaccggcaacaaggccagacccgtgatcaccgacctgttcaagaagatccccgagcagaacagctccaagcggggcctggccgtgaacgacttcttgcaggtcaaaggcagcaacaacatcttcgccatcggcgacaacgcctttgccggcctgcctcctacagcccaggtagcccaccaggaagccgagtacctggccaagaacttcgacaagatggctcagatccccaatttccagaagaacctgtcctcccggaaggataagatcgacctgctgttcgaggaaaacaacttcaagcccttcaagtacaacgatctgggcgccctggcctacctgggcagcgaaagagccattgccaccatcagaagcggcaagcggaccttctacaccggcggaggcctgatgaccttctacctgtggcggatcttgtacctgagcatgatcctgagcgcccgcagcagactgaaggtgttcttcgactggatcaagatggccttcttcaaaagggacttcttcaagggcctgtga

SEQ ID NO: 131 - DNA, 1542 bp, Artificial Sequence
  source: /note="Description of Artificial Sequence: Synthetic polynucleotide"
atgctaagcaagaatctgtacagcaacaagcggttgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaattttgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcctgccgaaattaagtacgactatctgatcagcgccgtaggcgccgagcccaacacctttggaattcccggcgtgaccgactacggccacttcctgaaagagatccccaacagcctggaaatacggcggactttcgccgccaacctggaaaaggccaacctgttgccaaagggcgaccccgagcggagaaggctgctgagcatcgtggtcgtgggcggaggccccacaggcgtggaggctgctggcgaactgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaagtgcacctgagaaccgccgtggccaaggtggaagagaagcagctgctggccaagaccaagcacgaggacggcaagataaccgaggaaactatcccatacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgaatacctggccaagaacttcgacaagatggcccagatccccaatttccagaagaacctgtcctccagaaaggataagatcgatctgctgttcgaggagaacaacttcaagcccttcaagtacaacgacctgggcgccttagcctacctgggcagcgaaagagccattgccaccatcagaagcggcaagcggaccttctacaccggtggaggcctgatgaccttctacctgtggcggattctgtacctgagcatgatcctgagcgcccgcagcagactgaaggtgttcttcgactggatcaagctggccttcttcaagagagacttcttcaagggcctgtga

SEQ ID NO: 132 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtccgcttcgccagcaccagatccaccggcgtcgaaaacagcggggctggccccaccagcttcaagaccatgaaggtcatcgaccctcagcacagcgacaagcccaacgtgctgatcctgggctctggctggggcgccatctcgtttctgaagcacatcgacaccaagaagtacaacgtcagcatcatctctcccagaagctacttcctgttcacccccctgctgcccagcgcacctgtgggaaccgtggacgagaagtccatcatcgagcccatcgtgaactttgccctgaagaaaaagggcaacgtcacctactacgaggccgaggccaccagcatcaatcccgacaggaacaccgtgaccatcaagagcctgagcgccgtgtcccagctgtaccagcccgagaaccacctgggcctgcaccaggccgagcccgccgagattaagtacgactacctgatcagcgccgtaggcgccgagcccaacacctttggaatccccggcgtgaccgactacggccacttcctgaaagagattcccaacagcctggaaatccggcggaccttcgccgccaacctggaaaaggccaacctgctgcctaagggcgatcccgagcggagaaggctgctgagcatcgtggtcgtgggcggaggccccacaggcgtggaagctgctggcgagctgcaggactacgtgcaccaggacctgcggaagtttctccccgccctggccgaggaagtgcagattcacctggtggaagccctgcccatcgtgctgaacatgtttgagaagaagctgagcagctacgcccaaagccacctggaaaacacctccatcaaggtgcacctgagaaccgccgtggccaaggtggaagagaagcaattgttggccaagaccaagcacgaggacggcaagattaccgaggaaaccatcccctacggcaccctgatttgggccaccggcaacaaggccagacccgtgatcaccgacctgttcaagaaaatccccgagcagaacagcagcaagcggggcctggccgtgaacgactttctgcaggtgaaaggcagcaacaacatcttcgccatcggcgacaacgcctttgccggcctgcctcctacagcccaggtggcccaccaagaagccgagtacctggccaagaacttcgacaagatggcccagatccccaatttccagaagaacctgtcctcccggaaggataagatcgacctcctgttcgaggaaaacaacttcaaacccttcaagtacaacgacctgggcgccctggcctacctgggcagcgaaagagccattgccaccatcagaagcggcaagcggaccttctacaccggcggaggcctgatgaccttctacctgtggcagatcctgtacctgtccatgatcctaagcgcccgcagcagactgaaggtgttcttcgactggatcaagctggcctttttcaaaagggactttttcaagggcctgtga

SEQ ID NO: 133 - DNA, 1542 bp, Artificial Sequence
  source: /note="Description of Artificial Sequence: Synthetic polynucleotide"
atgctgagcaagaacctgtatagcaacaagcggctgctgaccagcacgaataccctcgtgcgcttcgccagcaccagatccaccggcgtcgaaaacagcggggctggccccaccagctttaagaccatgaaggtcatcgacccccagcacagcgacaagcccaacgtgctgatactgggctctggctggggcgccatcagctttctgaagcacatcgacaccaagaagtacaacgtcagcatcatcagccccagaagctacttcctgttcacccccctgctgcccagcgcccctgttggaaccgtggacgagaagtccatcatcgagcccatcgtgaacttcgctctgaagaaaaagggcaacgtcacctactacgaggccgaggccaccagcatcaaccccgaccggaacaccgtgaccatcaagagcctgagcgccgtgagccagctgtaccagcccgagaaccacctgggcctgcaccaggccgagcccgccgagattaagtacgactacctgatcagcgccgtgggtgccgagcccaacacctttggaatccccggcgtgaccgactacggccacttcctgaaagagatccccaacagcctggaaatacggcggaccttcgccgccaacctggaaaaggccaacctgctgcctaagggcgaccccgagcggagaaggctgctgagcattgtggtcgtgggcggagggcccacaggcgtggaagctgctggcgaactgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaagtgcacctgagaaccgccgtggccaaggtggaagagaagcagctgctggccaagaccaagcacgaggacggcaagattaccgaggaaaccatcccctacggcaccctgatttgggccaccggcaacaaggcaagacccgtgatcactgacctgttcaagaaaatccccgagcagaactcgagcaagcggggcctggccgtgaacgacttcctgcaggtcaaaggcagcaacaacatcttcgccatcggcgacaacgcctttgccggcctgcctcctacagcccaggtggcccaccaggaagccgagtatctggccaagaacttcgacaagatggcccagatcccaaatttccagaagaacctgtcctcccggaaggataagatcgacctgttgttcgaggaaaacaacttcaagcccttcaagtacaacgacctgggtgccctggcctacctgggaagcgaaagggccattgccaccatcagaagcggcaagcggaccttctacaccggcggaggcctgatgaccttctacttatggcagatcctgtacctgagcatgatcctaagcgcccgcagcagactgaaggtcttcttcgactggattaagctggcattcttcaagagggacttcttcaagggcctgtga

SEQ ID NO: 134 - DNA, 1542 bp, Artificial Sequence
  source: /note="Description of Artificial Sequence: Synthetic polynucleotide"
atgctgagcaagaatctgtacagcaacaagcggttgctgaccagcaccaacaccctcgtccgcttcgccagcaccagatccaccggggtcgaaaactccggggctggccccaccagcttcaagaccatgaaggtcatcgacccccagcacagcgacaagcccaacgtgctgatcctgggctctggctggggagccatcagctttctgaagcacatcgacaccaagaagtacaacgtcagcatcatcagccccagaagctacttcctgttcacgcccctgctgcccagcgcacctgtgggaaccgtagacgagaagtccatcatcgagcccatcgtgaacttcgccctgaagaaaaagggcaacgtcacctactacgaggccgaagccaccagcatcaaccccgaccggaacaccgtgaccatcaagagcctgagcgccgtgtcccagctataccagcccgagaaccacctgggcctgcaccaggcagagcccgccgagattaagtacgactacctgatcagcgccgtgggcgccgagcccaacacctttggaatccccggcgtgaccgactacggccacttcttcaaagagatccccaacagcctggaaatccggagaaccttcgccgccaacctggaaaaggccaacctgctgcctaagggcgaccccgagcggagaaggctgctgagcatcgtggtcgtgggcggtggccccactggcgtggaagctgctggcgagctgcaggactacgtgcaccaggacctgagaaagttcctgcccgccctggccgaggaagtccagattcacttggtggaagccctgcccatcgttctgaacatgttcgagaagaagctgagcagctacgcccagagccacctggaaaacacttccatcaaggtgcacctgagaaccgccgtggccaaggtggaagagaagcagctgctggccaagaccaagcacgaggacggcaagattaccgaggaaaccattccctacggcaccctgatttgggccaccggcaacaaggccagacccgtgatcaccgacctgttcaagaagatccccgagcagaacagcagcaagcggggcttggccgtgaacgacttcctgcaggtcaaaggcagcaacaacatcttcgccatcggcgacaacgcatttgccggcctgcctcctacagcccaggtggcccaccaggaggccgagtacctggccaagaacttcgataagatggcccagatccccaatttccagaagaacctgtcctcccggaaggataagatcgacctgctgttcgaggaaaacaacttcaagcccttcaagtacaacgacctgggtgccctggcctacctgggcagcgaaagagccattgccaccatcagatccggcaagcggaccttctacaccggcggaggcttaatgaccttctacctgtggcggatcctgtacctgagcatgatcctgagcgcccgcagcagactgaaggtgtttttcgactggatcaagctggccttcttcaagagggacttcttcaagggcctgtga

SEQ ID NO: 135 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 136 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 137 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 138 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacctgagcatgatcctgagcgcccgcagcagactgaaggtgttcttcgactggatcaagctggccttcttcaagagggacttcttcaagggcctgtga

SEQ ID NO: 139 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 140 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 141 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttagcggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 142 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 143 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 144 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 145 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcgagggcctgtga

SEQ ID NO: 146 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 147 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 148 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaattagcatttttcaaaagagacttttttaaaggattatag

SEQ ID NO: 149 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 150 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaaatggcatttttcaaaagagacttttttaaaggattatag

SEQ ID NO: 151 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaaatggcatttttcaaaagagacttttttaaaggattatag

SEQ ID NO: 152 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 153 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaattagcatttttcaaaagagacttttttaaaggattatag

SEQ ID NO: 154 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 155 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 156 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttgagggattatag

SEQ ID NO: 157 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttagcgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 158 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 159 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 160 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 161 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaaatggcatttttcaaaagagacttttttaaaggattatag

SEQ ID NO: 162 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 163 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 164 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 165 - DNA, 1542 bp, Artificial Sequence
  source: /note="Description of Artificial Sequence: Synthetic polynucleotide"
atgctaagcaagaacttgtatagcaacaagcggttgctcaccagcaccaacaccctagtcagattcgcttccaccagatccacaggcgtcgaaaactccggggctggtcctacaagcttcaagaccatgaaggtcattgaccctcagcacagcgacaaaccaaacgtgctgatcctgggctctgggtggggagctatttcgtttttaaagcacattgacaccaagaagtacaacgtttccatcatctctcccagaagctatttcttatttacgcccttgttaccttctgccccagtggggacagtagacgagaagtcaatcatcgagcccatcgtgaatttcgctctcaagaaaaagggcaacgttacctactacgaggcagaggccacctctatcaatcccgacaggaataccgttaccatcaagtcattatctgccgttagccagctgtaccaacctgaaaaccatctagggctgcatcaagcagagcctgctgaaattaagtacgattatttaatcagtgctgtaggtgcggagcctaacacctttggtattcccggggtcaccgattacggtcatttcctggaggaaattcccaacagcttggaaatacggcggacttttgccgccaatctagaaaaggctaacttactgccaaagggtgatcccgaaagaagaaggctactgtccattgtcgtggtgggcggtggccctacaggcgtagaggctgctggtgaactgcaggactacgttcaccaggacctgcggaagtttctgcccgccttggccgaagaagtccaaattcacttggtcgaagctctgcccatcgtgctgaacatgtttgagaaaaagctgagcagctacgcgcagtcacatctggaaaacacttcgatcaaagtacatctgagaacggctgtcgccaaagtggaagagaagcaattgttggcaaagaccaaacacgaggacggtaaaattaccgaagaaactatcccatacggtaccttgatttgggccacgggtaacaaggcaagaccggtaatcactgacctgttcaagaagattcctgagcaaaactcgagcaagagaggattggcagtgaatgactttctgcaggtgaaaggcagcaacaacatcttcgccattggtgacaacgcatttgctgggttgccacctacagcccaggtagcccaccaagaggccgaatatttggccaagaatttcgacaaaatggctcaaataccaaatttccaaaagaacctgtcttccagaaaggataagattgatctgttgttcgaggagaacaactttaaacctttcaaatacaacgatttaggtgccttagcatacctgggatccgaaagggccattgcaaccatccgtagcggtaagcggaccttttacaccggtggtggcttaatgaccttctacctgtggcagattttgtacttgagcatgatcctatctgcaagatcgagattaaaggtgtttttcgactggattaagctggcatttttcaagagagacttttttaaaggattatag

SEQ ID NO: 166 - DNA, 1542 bp, Artificial Sequence
  source: /note="Description of Artificial Sequence: Synthetic polynucleotide"
atgctaagcaagaacttgtatagcaacaagaggttgctgacctcgacgaatacgctagtcagattcgcttccaccagatccacaggggtcgaaaactccggagctggccctacatcttttaagaccatgaaagtcattgaccctcagcacagcgacaaacccaacgtgctgatcctgggttcgggctggggcgctatcagctttctgaagcacattgacaccaagaagtacaacgtttccatcatctctcctagaagctatttcctgcacacccctctgttaccttctgcaccagttgggacagtagacgaaaagtcaattattgagcccatcgttaattttgctctcaagaaaaaggggaacgttacctactatgaggcagaagccacctctatcaaccccgacaggaacaccgttaccataaaaagcctgtctgccgttagccagctgtaccagcccgagaaccatctagggctgcatcaggcagaacctgccgaaattaagtacgattacctgatcagtgctgtgggtgcggaacctaacacatttggtattcctggggtcactgactacggtcacttcctgaaggaaatccccaactctctggaaatcagaagaacttttgccgccaatctggagaaggccaacctgttgcctaagggcgatcccgaaagaagaaggctactgtccattgtcgtggttggtggaggccctactggtgtggaggccgctggcgaactacaggattacgttcaccaggacctgcggaagtttctgcccgcactggccgaggaagtccaaattcacttggtcgaagctctgcccatcgttctgaacatgtttgagaagaagctttcaagctacgcgcaaagccatctggaaaacacttcgatcaaagtacacctgagaacggctgtcgccaaggttgaagaaaagcagttgttggcaaagaccaagcacgaagacggtaaaataaccgaagaaaccattccatacggcactttgatttgggccacgggtaacaaggcaagaccggtgatcactgaccttttcaagaagatccctgagcagaactcgtccaagagaggcctggccgtgaatgactttttgcaggtgaaaggcagcaacaacattttcgccattggtgacaacgcctttgctgggttgccacctaccgcccaagtggcgcaccaagaagccgaatatttggccaagaacttcgataagatggctcagatacccaatttccagaagaacctgtcttcaagaaaggataagattgatctcttgttcgaggagaacaactttaaacccttcaaatacaacgacctgggtgccctggcatacctgggaagcgaaagggccattgcaaccatacgtagcggtaagagaaccttttacaccggtggtggcctgatgaccttctacttatggcggattttgtacttgtccatgattctatctgcaagatcgagactgaaggtgtttttcgactggattaaaatggcattcttcaaaagagacttcttcaaaggcttatag

SEQ ID NO: 167 - DNA, 1542 bp, Artificial Sequence
  source: /note="Description of Artificial Sequence: Synthetic polynucleotide"
atgctatcgaagaatttgtatagtaacaagaggttgctcacctcgacgaacacgctagtgagattcgctagcaccagatccaccggcgtggaaaacagcggggctggtcctacctctttcaagaccatgaaagtcattgacccccagcacagcgacaaaccaaacgtgctgatactgggctcgggctggggagctatctcgtttttaaagcacatcgacaccaagaagtacaacgtttccatcatctctcctagaagctatttcttattcacgcctctgttaccttctgcaccagttggaacagtagacgaaaagtccatcattgagcccatcgttaactttgctctcaagaaaaagggcaacgtcacctactacgaggcagaagccacctctatcaatcccgaccggaataccgttaccataaagagcttatctgccgtttcccagctataccagcctgaaaaccacctagggctgcatcaggcagaacctgctgagattaagtacgattatttaatcagtgctgtaggtgccgagcctaacacctttggaatccctggcgtcaccgattacggtcatttcctggaggaaattcccaacagcttggaaatacggagaacttttgccgccaatctagagaaggctaacttattgccaaagggtgatcccgaaagaagaaggctgctgagcatcgtcgtggttggcggaggccccactggcgtagaagccgctggcgaactgcaggattatgttcaccaggacctgagaaagtttctgcctgcattggccgaagaagtccaaattcacctggtcgaagctctgcccatcgttttgaacatgtttgagaaaaagcttagctcatacgcgcaatcacatttagaaaacacttcgatcaaagtacatctgagaacggctgtcgccaaggttgaagaaaagcaattgttggcaaagaccaagcacgaagacggtaaaataaccgaagaaactattccatacggcactctgatttgggccaccggtaacaaggcaagaccggtaatcactgacctgttcaagaaaatccctgagcaaaactcgtccaagagaggcctggcagtgaacgacttcttgcaggtcaaaggcagcaacaacattttcgccattggcgacaatgcctttgctggcctgcctcctaccgcccaagtagcgcaccaagaagccgaatatttggccaagaattttgataagatggctcagataccaaatttccagaagaacctgtcttcacggaaggataagattgatctgttgttcgaggagaacaactttaagcctttcaaatacaacgatttaggtgccttagcctacctgggatccgaaagagccattgcaaccatacgttccggcaagagaaccttctacaccggtggaggcttaatgaccttctacctgtggcagattttgtacttgtccatgattctatctgccagaagcagattaaaggtcttcttcgactggatcaaattagcctttttcaaaagagacttttttaagggcttatga

SEQ ID NO: 168 - DNA, 1542 bp, Artificial Sequence
  source: /note="Description of Artificial Sequence: Synthetic polynucleotide"
atgctatcgaagaatctgtatagtaacaagcggttgctcacctcgacgaacaccctcgtgcgcttcgcttccaccagatccaccggcgtggaaaactccggggcaggtcccacatcttttaagaccatgaaggtcatcgaccctcagcacagcgacaagcccaacgtgctgatactgggttctgggtggggagctatctcgtttctgaagcacattgacaccaagaagtacaacgtcagcatcatctctcctagaagctacttcttatttacgcctctgttaccctctgcacctgtggggacagtagacgaaaagtcaattattgagcccatcgttaatttcgccctgaagaaaaagggcaacgtcacctactacgaggccgaggccacctctatcaatcccgacaggaataccgttaccataaaatcattatctgccgtttcccagctataccaacccgaaaaccatctggggctgcatcaagcagaacctgctgaaattaagtacgactacctgatcagtgctgtaggtgcggagcctaacacatttggtatccctggggtcactgactacggtcatttcctgaaggaaattcccaactctttggaaatccggagaacttttgccgccaatctagagaaggctaacttattgccaaagggcgaccccgagagaagaagactactgtccattgtggtcgttggtggagggcctactggtgtagaggccgctggcgaactacaggactatgttcaccaggacctgagaaagtttctccccgccctggccgaagaagtgcaaattcacttggtggaagctctgcccatcgttttgaacatgtttgagaaagagctttcatcatacgcccaatcacacctggaaaacacttcgatcaaagtacatctgagaacggccgtcgccaaagttgaagagaagcaactgttggcaaagaccaagcacgaggacggtaaaataaccgaagaaactattccctacggcactctgatttgggccaccggtaacaaggccagaccggtaatcactgaccttttcaagaagatccccgagcaaaacagctccaagagaggactggcagtgaatgactttttgcaggtgaaaggcagcaacaacatcttcgccatcggcgacaatgcatttgctgggttgccacctaccgcccaagtggcgcaccaagaggccgaatatatcgccaagaattttgataaaatggcccagatacccaatttccaaaagaacctatcttcaagaaaggataagatcgatctcttgttcgaggaaaacaactttaaacctttcaagtacaacgatttaggtgccttagcatacctgggatccgaaagagccattgcaaccatacgtagcggcaagagaacattttacaccggtggtggcttaatgaccttctacttatggagaattctgtacctgtccatgattctgtctgcaagatcgagattaaaggtctttttcgactggatcaaactggcattcttcaaaagagacttttttaaaggactgtag

SEQ ID NO: 169 - DNA, 1542 bp, Artificial Sequence
  source: /note="Description of Artificial Sequence: Synthetic polynucleotide"
atgctatcgaagaacctgtacagtaacaagaggttgctcaccagcacgaacacgatggtcagattcgcttccaccagatccacaggcgtcgaaaactccggagctggtcccacatctttcaagaccatgaaagtcatcgaccctcagcacagcgacaaacccaacgtgctgatcctgggttctggctggggcgctatctcgtttttaaagcacatcgacaccaagaagtacaacgtctccatcatctctcccagaagctatttcttatttacccctttgctgccttctgcacctgtgggaaccgtagacgaaaagtcaattattgagcccatcgttaattttgctctcaagaaaaagggcaacgttacctactacgaggcagaagccaccagcatcaatcccgacaggaataccgttaccatcaagtcattatctgccgtttcccagctataccagcctgaaaaccatctagggctgcatcaagccgaacctgctgaaattaagtacgattatttaatcagtgctgtgggcgcggaacccaacacatttggtattcccggggtcactgattacggtcatttcttcaaggaaattcccaactctttggaaatccggcggacttttgccgccaatctagagaaggctaacttattgcctaagggtgaccccgagagaagaagactactgtccattgtcgtggtgggtggtggccctactggcgtagaagccgctggtgaactacaggattatgttcaccaggacctgagaaagtttctccccgccctggccgaagaagtccaaattcacttggtcgaagctctgcccatcgtgttgaatatgtttgagaaaaagcttagctcatacgcccaatcacatttagaaaacacttcgatcaaggtacatctgagaacggctgtggccaaagttgaagaaaagcaactgttggcaaagaccaaacacgaagacggtaaaataaccgaagaaaccatcccatacggtactttgatttgggccacgggtaacaaggccagaccggtgatcactgaccttttcaagaagattcccgagcaaaactcgtccaagagaggcctggccgtgaatgactttttgcaggtcaaaggcagcaacaacatcttcgccatcggtgacaacgcctttgctgggctgccaccaacagcccaggtggcgcaccaggaggccgaatatctggccaagaatttcgataaaatggcccaaatccccaatttccaaaagaacctatcttcacggaaggataaaattgatctgttgttcgaggaaaacaacttcaaacctttcaaatacaacgacttaggcgccctggcatacctgggaagcgaaagggccattgccaccatccgttccggtaagagaacattttacaccggtggtggcttaatgaccttctacttatggcggatcctgtacctgtccatgattctatctgcaagatcgagattaaaggtcttcttcgactggattaaactggcatttttcaagagagacttttttaaaggactgtag

SEQ ID NO: 170 - DNA, 1542 bp, Artificial Sequence
  source: /note="Description of Artificial Sequence: Synthetic polynucleotide"
atgctatcgaagaatttgtatagcaacaagaggctgctcaccagcaccaatacgctcgtcagattcgcctccaccagatccacaggggtggaaaactccggagcaggtcctacaagctttaagaccatgaaggtcatcgaccctcagcacagcgacaagccaaacgtgctgatcctgggctctggctggggagccattagctttctgaagcacattgacaccaagaagtacaacgtctccatcatctctcccagaagctacttcttattcacgcctctgttaccctctgccccagttgggacagtagacgaaaagtccatcattgagcccatcgttaatttcgccctcaagaaaaaggggaacgttacctactatgaggccgaagccacctctatcaaccccgaccggaacaccgttaccataaaatcactgtctgccgttagccagctataccaacctgaaaaccatctaggcctgcaccaggcagagcctgctgaaattaagtacgattatttaatcagtgctgtgggtgcggaacccaacacatttggtattcctggggtcactgactacggccacttcctggaggagattcccaactctctggaaataagaagaacctttgccgccaatctagaaaaggccaacttactgccaaagggcgaccccgaaagaagaaggctactgagcattgtggtcgttggtggtgggcctactggtgtggaggccgctggtgaactacaggactatgttcaccaggacctgagaaagtttttccctgcattggccgaagaagtccaaattcacctggtcgaagccctgcccatcgttttgaatatgttcgagaaaaagctgtcatcatacgcccaatcacatttagaaaacacttcgatcaaggtacacctgagaacggctgtcgccaaagtggaagaaaagcagttgttggcaaagaccaaacacgaagacggtaaaataaccgaggaaaccattccatacggcactttgatttgggccacgggtaacaaggccagaccggtaatcactgaccttttcaagaaaatccctgagcaaaactcgagcaagagaggattggcagtgaacgactttctgcaggtgaaaggcagcaacaacattttcgccattggtgacaacgcatttgctgggttgccaccaaccgcccaggtagcgcaccaagaggccgaatatttggccaagaattttgataaaatggcccaaatcccaaatttccagaagaatctgtcttccagaaaggataaaattgatctcttgttcgaggaaaacaactttaagcctttcaaatacaacgacttaggtgccctggcatacctgggctccgaaagggccattgcaaccataagatccggtaagagaaccttttacaccggtggaggcttaatgaccttctacttatggagaatcctgtacctgagcatgattctatctgcacgcagcagactgaaggtctttttcgactggatcaaactggcctttttcaaaagagactttttcaaaggattatag

SEQ ID NO: 171 - DNA, 1542 bp, Artificial Sequence
  source: /note="Description of Artificial Sequence: Synthetic polynucleotide"
atgctatcgaagaatttgtatagtaacaagcggttgctgacctcgacgaatacgctagtcagattcgcctccaccagatccacaggggtggaaaactccggagctggccctacctcttttaagaccatgaaagtcattgaccctcagcacagcgacaaacccaacgtgctgatactgggctcggggtggggagccatttcgtttttaaagcacattgacaccaagaagtacaacgttagcatcatctctcctagaaagtacttcttatttacccctttgctgcctagcgcaccagttggaacagtagacgagaagtccattattgagcccatcgtgaactttgccctcaagaaaaaggggaacgttacctactatgaggcagaagccaccagcatcaatcccgacaggaacaccgtgaccataaagtcactgagcgccgtgagccagctataccaacccgaaaaccatctaggcctgcatcaagcagaacctgctgaaattaagtacgactatttaatcagcgccgtaggtgcggaacctaacacctttggtattcctggggtcactgactacggtcacttcctgaaggaaattcccaacagcttggaaatacggagaacttttgccgccaatctagagaaggctaacctgttgccaaagggtgatcccgagagaagaagactactgtccattgtggtcgttggcggtgggcctactggtgtggaggccgctggcgaactacaggattatgttcaccaggacctgagaaagttcctccctgcactggccgaagaagtgcaaattcacttggtcgaagctctgcccatcgtgctgaacatgttcgagaaaaagcttagctcatacgcccaaagccatttagaaaacacttcgatcaaagtacatctgagaaccgccgtggccaaggttgaagaaaagcaattgttggcaaagaccaaacacgaagacggcaaaattaccgaagaaactatcccctacggtaccttgatttgggccacgggtaacaaggcaagacccgtaatcaccgacctgttcaagaagatccccgagcagaactcgtccaagcggggactggcagtgaatgactttttgcaggtcaaaggcagcaacaacattttcgccattggtgacaatgcatttagcggcctgcctccaacagcccaggtggcgcaccaagaagccgaatacttggccaagaatttcgataagatggctcagatcccaaatttccaaaagaatctatcttcaagaaaggataaaattgacctcttgttcgaggagaacaactttaaacctttcaaatacaacgatctgggtgccctggcatacctgggatccgaaagggccattgcaaccatcagatccggtaagagaacattttacaccggtggtggcttaatgaccttctacttatggcggatcttgtacttgagcatgattctaagcgcaagatcgagattaaaggtctttttcgactggatcaaattagcattcttcaaaagggactttttcaaaggcttatga

SEQ ID NO: 172 - DNA, 1542 bp, Artificial Sequence
  source: /note="Description of Artificial Sequence: Synthetic polynucleotide"
atgctgagcaagaacttgtatagtaacaagaggctgctcacctcgacgaacacgctagtcagattcgctagcaccagatccacaggcgtcgaaaacagcggagcaggtcctacatcttttaagaccatgaaagtcattgaccctcagcacagcgacaaaccaaacgtgctgatactgggttcggggtggggcgccatttcgtttctgaagcacattgacaccaagaagtacaacgtttccatcatctctcctagaagctatttcctgtttacgcccttgctgccttctgccccagtggggacagtagacgaaaagtccattatcgagcccatcgttaattttgctctcaagaaaaaggggaacgttacctactatgaggcagaagccaccagcatcaaccccgaccggaataccgttaccataaaatcactgtctgccgttagccagctgtaccaacctgaaaaccatctggggctgcatcaagcagaacctgctgaaattaagtacgactatttaatcagcgctgtaggtgccgaacctaacacatttggtattcccggcgtcactgattacggtcatttcttcaaggaaattcccaactctttggaaataagaagaacttttgccgccaatctagagaaggctaacttattgcctaagggtgatcccgaaagaagaagactgctgtccattgtcgtggttggtggagggcctactggtgtggaggccgctggtgagctacaggactatgttcaccaggacctgagaaagtttctgcctgcattggccgaggaagtccaaattcacctggtcgaagctctgcccatcgtgctgaacatgttcgagaaaaagctgtcatcatacgcccaaagccacttagaaaacacctcgatcaaagtgcatctgagaaccgctgtcgccaaggttgaagaaaagcaattgctggcaaagaccaaacacgaggacggtaaaataaccgaggaaactattccctacggcactctgatttgggccaccggtaacaaggccagacccgtaatcactgaccttttcaagaaaattcctgagcaaaacagctccaagagaggcttggccgtgaacgactttttgcaggtcaaaggcagcaacaacattttcgccattggtgacaacgcatttgccggcttgccaccaaccgcccaagtagcccaccaagaggccgaatacatcgccaagaattttgataagatggctcaaatacccaatttccagaagaatctatcctcaagaaaggataaaatcgacctcttgttcgaggaaaacaactttaagcccttcaagtacaacgacttaggcgccttagcatacctgggctccgaaagggccattgcaaccatcagatccggtaagcggaccttctacaccggtggtggcttaatgaccttctacctgtggcggattttgtacttgagcatgattctgagcgcaagatcgagactgaaggtgtttttcgactggatcaaattagcatttttcaaaagagacttcttcaaaggattatga

SEQ ID NO: 173 - DNA, 1542 bp, Artificial Sequence
  source: /note="Description of Artificial Sequence: Synthetic polynucleotide"
atgctatcgaagaatttgtacagtaacaagaggttgctcacctcgaccaatacgctagtcagattcgcttccaccagatccacaggcgtggaaaactccggagcaggtcctacctcttttaagaccatgaaggtcatcgaccctcagcacagcgacaaaccaaacgtgctgatactgggttcgggctggggagccatttcgtttttaaagcacattgacaccaagaagtacaacgttagcatcatctctcctagaaagtatttcttacacacgcctttgctgcctagcgccccagttgggacagtagacgaaaagtcaatcattgagcccatcgttaatttcgctctgaagaaaaaggggaacgttacctactatgaggcagaagccaccagcatcaatcccgaccggaataccgtgaccataaaatcattaagcgccgttagccagctataccaacctgaaaaccacctaggcctgcatcaagccgaacctgctgaaattaagtacgactacttaatcagcgctgtgggtgcggaacctaacacctttggtattcccggcgtgaccgattacggtcatttcctgaaggaaattcccaactctttggaaataagaagaacctttgccgccaatctagagaaggctaacctgttgccaaagggcgatcccgagagaagaagactactgagcatcgtcgtggttggtggtgggcctactggtgtggaagccgctggtgaactacaggattacgtgcaccaggacctgagaaagtttctgcctgccttggccgaggaagtgcaaattcacttggtcgaagctctgcccatcgttttgaatatgttcgagaaaaagctgagctcatacgcgcagagccacctggaaaacacttcgatcaaggtacatctgagaaccgctgtcgccaaagttgaagaaaagcaattgctggcaaagaccaagcacgaagacggcaaaataaccgaagaaaccatcccatacggtactttgatttgggccaccggtaacaaggccagacccgtaatcaccgacctgttcaagaagattcctgagcagaactcgtccaagagaggactggcagtgaacgactttctgcaggtgaaaggcagcaacaacattttcgccattggtgacaatgcatttgctggcctgccaccaaccgcccaagtggcgcaccaagaggccgaatacttggccaagaatttcgacaaaatggctcaaataccaaatttccaaaagaatctatcttcacggaaggataagatcgacctgctgttcgaggaaaacaactttaaacccttcaaatacaacgatctgggtgccttagcatacctgggatccgaaagggccattgcaaccatccgttccggtaagagaacattctacaccggcggtggcttaatgaccttctacttatggcggatcttgtacctgtccatgatcctaagcgccagatcgagattaaaggtgttcttcgactggatcaaattagccttcttcaaaagagacttcttcaaaggattatag

SEQ ID NO: 174 - DNA, 1542 bp, Artificial Sequence
  source: /note="Description of Artificial Sequence: Synthetic polynucleotide"
atgctatcgaagaacttgtatagtaacaagcggttgctcaccagcacgaatacgctagtccgcttcgcctccaccagatccaccggggtggaaaacagcggggctggtcctacatctttcaagaccatgaaagtcattgaccctcagcacagcgacaagccaaacgtgctgatactgggctcggggtggggagctatctcgtttctgaagcacattgacaccaagaagtacaacgtttccatcatcagccccagaagctatttcctgtttacgcctttgctgccctctgcaccagtggggaccgtagacgaaaagtcaatcatcgagcccatcgtgaattttgctctcaagaaaaaggggaacgttacctactatgaggcagaggccacctctatcaatcccgacaggaataccgtgaccataaaatcattatctgccgttagccagctgtaccagcctgaaaaccatctagggatgcatcaagcagagcctgctgagattaagtacgattatctgatcagtgccgtaggtgcggaacctaacacatttggtatccccggggtcactgactacggtcatttcctgaaggaaattcccaacagcttggaaatcagaagaaccttcgccgccaatctagagaaggctaacctgttgcctaagggcgaccccgaaagaagaagactactgtccattgtggtggttggcggagggcccacaggtgtagaggccgctggtgaactacaggattatgtgcaccaggacctgagaaagttcctccctgccctggccgaagaagtgcaaattcacttggtcgaagccctgcccatcgttttgaatatgtttgagaaaaagctttcatcatacgcgcagtcacatttagaaaacacttcgatcaaagtgcatctgagaacggctgtggccaaagttgaagaaaagcaactgttggcaaagaccaaacacgaagacggtaagattaccgaagaaaccattccatacggcactctgatttgggccacgggtaacaaggcaagaccggtaatcactgaccttttcaagaaaatccctgagcaaaacagcagcaagcggggattggccgtgaatgacttcttgcaggtgaaaggcagcaacaacatcttcgccattggcgacaatgcctttgctggcctgccaccaaccgcccaagtagcgcaccaggaagccgagtatttggccaagaactttgataaaatggcccaaatcccaaatttccaaaagaacctatcttcaagaaaggataaaattgatctcctgttcgaggagaacaacttcaagcctttcaagtacaacgatctgggtgccctggcctacctgggatccgaaagggccattgccaccatccgtagcggtaagagaaccttttacaccggtggaggcctgatgaccttctacttatggagaattctgtacttgtccatgattctatctgccagaagcagactgaaggtctttttcgactggattaaattagcctttttcaaaagagactttttcgagggattatag

SEQ ID NO: 175 - DNA, 1542 bp, Artificial Sequence
  source: /note="Description of Artificial Sequence: Synthetic polynucleotide"
atgctatcgaagaatctgtacagtaacaagaggttgctcacctcgacgaatacgctcgtccgcttcgcctccaccagatccacaggcgtggaaaacagcggagcaggtcccacatcttttaagaccatgaaagtcattgacccccagcacagcgacaagccaaacgtgctgatactgggttcggggtggggagccattagctttttaaagcacattgacaccaagaagtacaacgttagcatcatctctcccagaagctatttcttatttacccctctgttacctagcgcaccagtggggacagtggacgagaagtcaattattgagcccatcgttaatttcgccctcaagaaaaaggggaacgtcacctactacgaggcagaagccacctctatcaaccccgacaggaataccgtgaccataaaaaacttatctgccgttagccagctataccaacctgagaaccatctggggctgcatcaggcagagcccgctgaaattaagtacgattatttaatcagcgctgtaggtgcggagcctaacacatttggtattcctggggtgactgattacggtcatttcctggaggaaattcccaactctttggaaataagaagaacttttgccgccaacctggagaaggctaacttattgcctaagggcgatcccgaacggagaagactgctgagcattgtggtcgttggtggagggcctactggtgtagaagctgctggcgaactgcaggattacgttcaccaggacctgcggaagtttctccccgcattggccgaagaagtccagattcacctggtcgaagccctgcccatcgtgctgaacatgtttgagaaaaagcttagctcatacgcgcagagccacttagaaaacacttcgatcaaagtacatctgagaacggctgtcgccaaggtggaagagaagcaactgctggccaagaccaaacacgaagacggcaaaataaccgaagaaactattccctacggcactttgatttgggccaccggtaacaaggcaagaccggtaatcactgaccttttcaagaaaattcctgagcaaaacagctccaagcggggattggcagtgaatgactttttgcaggtcaaaggcagcaacaacattttcgccatcggtgacaacgcctttgctgggttgcctccaaccgcccaagtagcgcaccaggaggccgagtatttggccaagaattttgataaaatggctcagatacccaatttccagaagaatctatcctcaagaaaggataagattgatctcttgttcgaggaaaacaactttaaacctttcaaatacaacgatctgggcgccttagcatacctgggatccgaaagggccattgccaccatccgttccggtaagagaacattttacaccggcggtggcttaatgaccttctacttatggagaattttgtacttgtccatgatcctatctgcacgcagcagactgaaggtctttttcgactggattaagttagcattcttcaagagggacttttttaaaggactgtag

SEQ ID NO: 176 - DNA, 1542 bp, Artificial Sequence
  source: /note="Description of Artificial Sequence: Synthetic polynucleotide"
atgctgagcaagaacttgtatagtaacaagaggttgctgacctcgaccaatacgctagtgagattcgcttccaccagatccacaggggtggaaaactccggggctggtcctacatctttcaagaccatgaaagtcattgaccctcagcacagcgacaaacccaacgtgctgatactgggttcgggctggggcgccatttcgtttttaaagcacattgacaccaagaagtacaacgtttccatcatctctcctagaaagtacttcctgttcacgcctttgttacctagcgcaccagtggggacagtggacgagaagtcaattattgagcccatcgttaactttgccctcaagaaaaaggggaacgttacctactacgaggcagaggccacctctatcaatcccgacaggaataccgttaccatcaaaagcttatctgccgtttcccagctataccagcctgaaaaccatctagggctgcatcaagcagaacctgctgaaattaagtacgactatttaatcagtgctgtgggtgcggagcccaacacctttggtattcctggggtgactgattacggccacttcctgaaagaaattcccaacagcttggaaataagaagaacttttgccgccaatctagaaaaggctaacttattgcctaagggtgaccccgaaagaagaaggctgctgtccatcgtcgtggttggtggtgggcctacaggtgtggaagccgctggtgagctgcaggactatgtgcaccaggacctgagaaagttcttccccgcactggccgaagaagtccaaattcacttggtcgaagctctgcccatcgttttgaatatgtttgagaagaagctgagctcatacgcgcaatcacacttagaaaacacctcgatcaaagtacatctgagaacggccgtggccaaagtggaagaaaagcaactgttggcaaagaccaaacacgaggacggtaagattaccgaagaaactattccctacggtactctgatttgggccacgggtaacaaggccagacccgtaatcactgaccttttcaagaaaatccccgagcaaaacagctccaagagaggactggccgtgaatgacttcttgcaggtgaaaggcagcaacaacattttcgccatcggcgacaacgcatttgccgggctgccaccaaccgcccaggtggcgcaccaggaggccgagtatttggccaagaattttgataaaatggcccaaataccaaatttccaaaagaacctatcttcaagaaaggataaaattgatctcttgttcgaggaaaacaactttaaacctttcaaatacaacgatctgggtgccttagcctacctgggatccgaaagagccattgccaccatccgttccggtaagcggacattttacaccggtggtggcttaatgaccttctacctgtggagaattttgtacttgtccatgattctaagcgcaagatcgagattaaaggtctttttcgactggatcaaattagcatttttcaaaagagacttttttaagggattatga

SEQ ID NO: 177 - DNA, 1542 bp, Artificial Sequence
  source: /note="Description of Artificial Sequence: Synthetic polynucleotide"
atgctatcgaagaacttgtatagtaacaagaggttgctcacctcgaccaatacgctagtcagattcgcctccaccagatccacaggggtggaaaacagcggagcaggtcctacaagctttaagaccatgaaagtcattgaccctcagcacagcgacaaaccaaacgtgctgatactgggttcggggtggggagctatctcgtttctgaagcacattgacaccaagaagtacaacgtctccatcatctctcccagaagctatttcctgcacacgcccttgttaccttctgcacctgtggggacagtggacgaaaagtcaatcatcgagcccatcgtgaactttgctctcaagaaaaaggggaacgttacctactacgaggccgaagccacctctatcaatcccgaccggaataccgttaccataaaatcactgagcgccgtgtcccagctataccagcccgaaaaccatctagggctgcatcaagcagaacctgctgaaattaagtacgattatttaatcagtgctgtgggcgccgaacccaacacatttggaattcctggggtgactgattacggccatttcctgaaagaaattcccaacagcttggaaataagacggaccttcgccgccaacctagaaaaggctaacttattgccaaagggtgatcccgagagaagaaggctgctgagcatcgtggtggtgggtggtgggcctactggcgtggaggctgctggtgaactgcaggattatgttcaccaggacctgagaaagttcctgcctgcactggccgaagaagtccaaattcacttggtcgaagctctgcccatcgtgttgaatatgtttgagaaaaagctgtcatcatacgcgcagtcacacttagaaaacacttcgatcaaggtacacctgagaacggctgtcgccaaggttgaagagaagcaattgttggcaaagaccaaacacgaagacggcaaaataaccgaagaaactattccatacggcaccttgatttgggccaccggcaacaaggccagaccggtgatcactgaccttttcaagaaaattcctgagcaaaacagcagcaagcggggactggccgtgaacgactttttgcaggtgaaaggcagcaacaacattttcgccatcggtgacaatgcatttagcggcttgccaccaaccgcccaggtggcgcaccaagaggccgaatacctggccaagaatttcgataaaatggctcaaataccaaatttccaaaagaacctatcctcaagaaaggataaaattgatctgttgttcgaggagaacaactttaaacctttcaaatacaacgatttaggcgccttagcatacctgggatccgaaagagccattgcaaccatacgttccggtaagagaacattctacaccggtggtggcttaatgaccttctacctgtggagaattttgtacttgtccatgatcctatctgcccgcagcagattaaaggtgtttttcgactggatcaaattagcatttttcaaaagagacttctttaaaggactgtga

SEQ ID NO: 178 - DNA, 1542 bp, Artificial Sequence
  source: /note="Description of Artificial Sequence: Synthetic polynucleotide"
atgctgtcgaagaatctgtatagtaacaagaggttgctcacctcgacgaatacgctcgtcagattcgcctccaccagatccacaggcgtggaaaactccggagctggtcccacatcttttaagaccatgaaagtcattgaccctcagcacagcgacaaaccaaacgtgctgatactgggttcgggctggggagctatttcgtttctgaagcacattgacaccaagaagtacaacgtctccatcatctctcctagaagctatttcttatttacgcctctgctgccttctgcaccagttgggacagtggacgaaaagtcaattattgagcccatcgtgaattttgccctcaagaaaaaggggaacgttacctactatgaggcagaagccacctctatcaaccccgacaggaataccgttaccatcaaatcactgagcgccgttagccagctataccaacccgaaaaccatctgggcctgcaccaagcagaacctgctgaaattaagtacgattatttaatcagtgctgtgggcgcggaacccaacacctttggtattcctggggtcactgactacggtcatttcctggaggaaattcccaacagcttggaaatcagaagaacctttgccgccaacctagaaaaggccaacttattgcctaagggtgatcccgagagaagaagactgctgtccatcgtcgtggttggtggaggccctactggtgtggaagctgctggtgaactgcaggattatgttcaccaggacctgcggaagtttctccctgcattggccgaggaagtgcaaattcacttggtcgaagctctgcccatcgttttgaatatgtttgagaaaaagctgtcatcatacgcgcaatcacacctggaaaacacctcgatcaaagtgcatctgagaacggctgtggccaaggttgaagaaaagcagttgttggcaaagaccaaacacgaagacggcaaaataaccgaggaaaccatcccatacggtactctgatttgggccaccggcaacaaggcaagaccggtaatcactgaccttttcaagaaaattcctgagcagaacagctccaagagaggcctggccgtgaatgacttcttgcaggtgaaaggcagcaacaacattttcgccattggtgacaatgcatttgctgggttgccaccaaccgcccaagtggcgcaccaagaagccgaatacatcgccaagaactttgataagatggcccaaatcccaaatttccagaagaacctgtcttcaagaaaggataaaattgacctcctgttcgaggagaacaactttaagcctttcaaatacaacgatttaggtgccttagcctacctgggctccgaaagggccattgcaaccatccgtagcggtaagcggaccttctacaccggcggtggcttaatgaccttctacttatggagaattttgtacctgtccatgattctgagcgccagaagcagattaaaggtcttcttcgactggatcaaactggcctttttcaagagagacttctttaaaggattatag

SEQ ID NO: 179 - DNA, 1542 bp, Artificial Sequence
  source: /note="Description of Artificial Sequence: Synthetic polynucleotide"
atgctgtcgaagaatttgtatagtaacaagaggttgctcaccagcacgaataccctcgtcagattcgccagcaccagatccacaggggtggaaaacagcggggctggccctacatctttcaagaccatgaaagtcattgaccctcagcacagcgacaaaccaaacgtgctgatactgggttcggggtggggcgccatttcgtttttaaagcacattgacaccaagaagtacaacgtttccatcatcagccctagaagctacttcctgtttacgcccttgttaccctctgccccagttgggacagtagacgaaaagtccatcatcgagcccatcgttaactttgctctcaagaaaaaggggaacgttacctactatgaggcagaagccacctctatcaatcccgaccggaataccgttaccataaaatcactgagcgccgtgtcccagctgtaccaacctgaaaaccatctgggcatgcatcaagcagaacctgctgaaattaagtacgactatttaatcagtgctgtaggtgcggagcccaacacatttggtatccccggcgtcactgactacggccatttcctgaaggagattcccaactctttggaaataagaagaacttttgccgccaacctagagaaggctaacttactgccaaagggtgatcccgaaagaagaagactactgtccatcgtcgtcgttggtggagggcctacaggtgtggaggccgctggtgaactacaggactatgtgcaccaggacctgagaaagttcctccccgcattggccgaagaagtccagattcacttggtcgaagctctgcccatcgttttgaacatgtttgagaaaaagctgtcatcatacgcccagtcacatttagaaaacacctcgatcaaagtgcatctgagaacggccgtcgccaaagttgaagaaaagcagctgttggcaaagaccaaacacgaagacggcaaaattaccgaagaaactatcccatacggtactctgatttgggccacgggtaacaaggcaagaccggtaatcactgacctgttcaagaaaattcccgagcaaaactcgagcaagagaggattggcagtgaacgactttttgcaggtgaaaggcagcaacaacatcttcgccattggtgacaatgcatttgccgggttgcctccaacagcccaagtagcgcaccaggaggccgaatacttggccaagaactttgacaaaatggctcagatccccaatttccaaaagaatctatcttccagaaaggataagatcgatctgttgttcgaggaaaacaactttaagcctttcaaatacaacgatctgggtgccttagcatacctgggatccgaaagggccattgccaccataagatccggtaagagaaccttttacaccggtggtggcctgatgaccttctacttatggcggatcttgtacttgtccatgatcctatctgcaagatcgagactgaaggtgtttttcgactggattaaattagcctttttcaagagagacttctttgagggcttatag

SEQ ID NO: 180 - DNA, 1542 bp, Artificial Sequence
  source: /note="Description of Artificial Sequence: Synthetic polynucleotide"
atgctatcgaagaatttgtacagtaacaagaggctgctcaccagcacgaacaccctagtcagattcgcttccaccagatccacaggggtggaaaactccggagctggtcccacaagctttaagaccatgaaagtcattgaccctcagcacagcgacaaaccaaacgtgctgatactgggttcggggtggggagctatttcgtttttaaagcacattgacaccaagaagtacaacgtctccatcatcagccccagaaagtacttcttatttacgcccttgttacctagcgcaccagtgggaacagtagacgaaaagtccatcatcgagcccatcgtgaattttgctctgaagaaaaaggggaacgttacctactatgaggccgaggccacctctatcaatcccgaccggaacaccgtgaccataaaatcattatctgccgttagccagctataccaacctgaaaaccatctagggctgcatcaagccgagcctgctgaaattaagtacgactatttaatcagtgctgtgggcgcggagcccaacacatttggtattcccggggtcactgattacggtcatttcctgaaagaaattcccaactctttggaaataagaagaactttcgccgccaatctagagaaggccaacttattgccaaagggcgaccccgagcggagaaggctactgtccattgtggtggtgggtggtggccctacaggtgtagaggccgctggtgaactacaggattatgttcaccaggacctgagaaagtttctccctgcattggccgaagaagtgcaaattcacctggtggaagccctgcccatcgttctgaatatgttcgagaaaaagcttagcagctacgcgcaatcacacctggaaaacacctccatcaaggtacatctgagaacggccgtcgccaaagttgaagaaaagcagctgctggccaagaccaagcacgaagacggtaagataaccgaagaaactattccatacggtaccttgatttgggccacgggtaacaaggcaagaccggtgatcactgaccttttcaagaaaattcccgagcagaactcgtccaagagaggcctggcagtgaatgactttttgcaggtcaaaggcagcaacaacatcttcgccattggtgacaacgcctttagcgggttgcctccaaccgcccaagtagcgcaccaggaggccgagtatctggccaagaatttcgataaaatggcccaaatacccaatttccaaaagaacctgtcttcaagaaaggataaaattgatctgctgttcgaggagaacaactttaaacctttcaaatacaacgatttaggcgccctggcatacctgggatccgaaagggccattgcaaccataagatccggtaagcggacattttacaccggtggtggcttaatgaccttctacctgtggagaattttgtacctgtccatgattctatctgcacgctcgagactgaaggtgtttttcgactggatcaaattagcattcttcaagagagacttttttaaaggattatga

SEQ ID NO: 181 - DNA, 1542 bp, Artificial Sequence
  source: /note="Description of Artificial Sequence: Synthetic polynucleotide"
atgctgtcgaagaatctgtatagcaacaagaggttgctgacctcgacgaatacgctagtccgcttcgcttccaccagatccaccggggtggaaaactccggagctggtcctacatcttttaagaccatgaaggtcattgacccccagcacagcgacaaaccaaacgtgctgatactgggttcggggtggggagctatcagctttttaaagcacattgacaccaagaagtacaacgttagcatcatctctcctagaagctatttcttatttacgcccttgttaccctctgcaccagttgggacagtggacgaaaagtcaatcatcgagcccatcgttaacttcgctctcaagaaaaaggggaacgttacctactacgaggccgaggccaccagcatcaatcccgacaggaacaccgttaccataaaaaacttatctgccgttagccagctgtaccaacccgagaaccatctagggctgcatcaggcagaacctgctgagattaagtacgattacttaatcagtgccgtaggcgcggaacccaacacatttggtattcctggggtgactgattacggtcatttcttcaaggagatccccaactctttggaaatacggagaaccttcgccgccaatctagaaaaggctaacttactgccaaagggtgaccccgagagaagaagactactgtccatcgtcgtggttggcggaggccccacaggcgtggaggccgctggtgagctacaggactatgtgcaccaggacctgagaaagttcctgcctgccctggccgaagaagtccaaattcacctggtcgaagctctgcccatcgtgctgaatatgtttgagaaaaagcttagctcatacgcgcaaagccatctggaaaacacctcgatcaaggtgcacctgagaacggctgtcgccaaagttgaagaaaagcagttgttggccaagaccaaacacgaggacggtaaaataaccgaagaaactattccctacggtactttgatttgggccacgggcaacaaggcaagaccggtgatcactgaccttttcaagaagatccctgagcaaaactcgtccaagagaggcttggccgtgaacgactttttgcaggtgaaaggcagcaacaacattttcgccatcggtgacaacgcctttgccggcttgccacctaccgcccaggtagcgcaccaggaggccgaatatttggccaagaattttgataagatggctcaaatacccaatttccaaaagaatctatcttcccggaaggataaaattgatctcttgttcgaggagaacaactttaaacctttcaaatacaacgatttaggtgccctggcatacctgggatccgaaagggccattgcaaccatacgtagcggtaagagaaccttttacaccggtggtggcctgatgaccttctacttatggcggatcttgtacttgtccatgattctatctgccagatcgagactgaaggtctttttcgactggattaaattagcattcttcaaaagagacttttttaaaggattatag

SEQ ID NO: 182 - DNA, 1542 bp, Artificial Sequence
  source: /note="Description of Artificial Sequence: Synthetic polynucleotide"
atgctaagcaagaatttgtacagtaacaagcggttgctcacctcgacgaacacgctagtcagattcgcttccaccagatccaccggggtggaaaactccggagcaggccctacaagctttaagaccatgaaagtcattgaccctcagcacagcgacaaacccaacgtgctgatactgggctctgggtggggagctatttcgtttttaaagcacattgacaccaagaagtacaacgttagcatcatctctcctagaagctatttcctgtttacgcccctgttaccctctgcaccagttggaacagtggacgagaagtccattatcgagcccatcgtgaattttgctctgaagaaaaaggggaacgttacctactacgaggcagaggccacctctatcaatcccgacaggaataccgttaccatcaagtcattaagcgccgtttcccagctataccaacctgagaaccatctgggcctgcatcaggcagagcctgccgaaattaagtacgactatttaatcagtgctgtaggcgccgaacctaacacatttggtatccccggcgtcactgattacggtcatttcttcaaagagattcccaacagcttggaaataagacggacttttgccgccaacctagaaaaggccaacctgctgcctaagggtgaccccgaaagaagaagactactgtccattgtcgtggttggtggtgggcctactggtgtagaggccgctggtgaactacaggattatgttcaccaggacctgagaaagtttctccccgcattggccgaagaagtccagattcacttggtggaagccctgcccatcgtgctgaatatgtttgagaaaaagcttagcagctacgcgcaatcacatttagaaaacacttcgatcaaagtacatctgagaaccgctgtcgccaaagttgaagaaaagcaattgttggcaaagaccaagcacgaagacggcaaaataaccgaagaaactattccatacggtactctgatttgggccaccggcaacaaggcaagaccggtgatcactgaccttttcaagaaaatccccgagcagaacagctccaagcggggcctggccgtgaatgactttttgcaggtgaaaggcagcaacaacatcttcgccatcggtgacaatgcatttagcgggctgccaccaacagcccaagtagcgcaccaagaggccgaatacttggccaagaactttgataagatggctcaaatcccaaatttccaaaagaatctgtcctccagaaaggataagattgatctcttgttcgaggaaaacaactttaagcctttcaaatacaacgacttaggtgccttagcatacctgggatccgaaagggccattgcaaccataagatccggcaagagaaccttttacaccggcggaggcttaatgaccttctacttatggagaattttgtacttgtccatgatcctgtctgcaagatcgagactgaaggtctttttcgactggattaaattagcattcttcaaaagagacttttttaagggattatag

SEQ ID NO: 183 - DNA, 1542 bp, Artificial Sequence
  source: /note="Description of Artificial Sequence: Synthetic polynucleotide"
atgctgtcgaagaacctgtacagtaacaagaggttgctcaccagcacgaacacgctcgtcagattcgcttccaccagatccacaggcgtggaaaactccggagcaggtcccacatcttttaagaccatgaaagtcatcgaccctcagcacagcgacaaaccaaacgtgctgatactgggttctgggtggggagctatcagctttctgaagcacattgacaccaagaagtacaacgtttccatcatctctcctagaagctacttcctgtttacgcctctgctgccttctgccccagtgggaaccgtagacgaaaagtcaattattgagcccatcgtgaatttcgctctgaagaaaaaggggaacgttacctactacgaggcagaggccaccagcatcaatcccgacaggaataccgtgaccataaaaaacttaagcgccgttagccagctataccagcccgaaaaccacctagggctgcaccaagcagagcctgctgaaattaagtacgattatttaatcagtgccgtaggtgcggaacctaacacatttggaattcctggggtcaccgactacggtcacttcctgaaagaaattcccaactctttggaaataagaagaacctttgccgccaatctagagaaggccaacttattgccaaagggtgatcccgaaagaagaaggctactgtccatcgtggtcgtgggcggtggccctactggtgtggaagccgctggtgagctacaggattacgttcaccaggacctgcggaagtttctccccgcactggccgaggaagtgcaaattcacttggtggaagccctgcccatcgttctgaacatgttcgagaagaagctttcatcatacgcgcaaagccatctggaaaacacctccatcaaagtacatctgagaacggctgtcgccaaagttgaagaaaagcaattgttggcaaagaccaagcacgaagacggtaaaataaccgaggaaactattccatacggtactttgatttgggccacgggtaacaaggccagaccggtaatcactgaccttttcaagaaaattcccgagcaaaactcgtccaagcggggcttggccgtgaatgactttttgcaggtgaaaggcagcaacaacattttcgccattggcgacaatgcctttagcgggctgccaccaacagcccaagtagcccaccaagaagccgaatatttggccaagaactttgataaaatggcccagataccaaatttccaaaagaacctatcttcacggaaggataagattgatctcttgttcgaggagaacaactttaaacctttcaaatacaacgatttaggcgccttagcatacctgggctccgaaagggccattgcaaccatccgttccggtaagcggacattttacaccggtggtggcctgatgaccttctacttatggagaattttgtacttgtccatgattctgtctgcaagaagcagattaaaggtctttttcgactggattaagctggcattcttcaagagagactttttcaaaggattatag

SEQ ID NO: 184 - DNA, 1542 bp, Artificial Sequence
  source: /note="Description of Artificial Sequence: Synthetic polynucleotide"
atgctgtcgaagaacttgtacagtaacaagcggttgctcacctcgacgaatacgctagtcagattcgcctccaccagatccacaggggtggaaaactccggggcaggccctacatctttcaagaccatgaaagtcatcgacccccagcacagcgacaaaccaaacgtgctgatactgggttcggggtggggcgctatctcgtttctgaagcacattgacaccaagaagtacaacgttagcatcatctctcctagaaagtatttcttatttacgcctttgttaccctctgcaccagtggggacagtggacgaaaagtcaattattgagcccatcgttaattttgccctgaagaaaaaggggaacgttacctactatgaggccgaagccacctctatcaaccccgaccggaataccgttaccataaaaagcttatctgccgttagccagctataccaacctgaaaaccatctagggctgcatcaggcagaacctgctgaaattaagtacgattatttaatcagtgctgtaggtgccgaacctaacacatttggtatccccggcgtgactgattacggccatttcctgaaggaaatccccaactctctggaaataagaagaacttttgccgccaatctagaggaggctaacctgctgccaaagggcgatcccgaaagaagaagactgctgtccattgtcgtcgtgggtggtgggcctacaggtgtggaagccgctggcgagctacaggattatgttcaccaggacctgagaaagtttctccctgcactggccgaagaagtccaaattcacctggtcgaagctctgcccatcgttctgaatatgtttgagaagaagcttagctcatacgcgcagtcacatttagaaaacacttcgatcaaagtacatctgagaacggctgtggccaaagttgaagaaaagcaattgttggcaaagaccaagcacgaggacggtaagataaccgaggaaaccattccctacggtactctgatttgggccaccggtaacaaggccagaccggtaatcaccgaccttttcaagaagatccctgagcagaactcgtccaagagaggattggcagtgaatgacttcttgcaggtcaaaggcagcaacaacatcttcgccattggtgacaatgcatttgccgggctgccaccaaccgcccaagtagcccaccaagaggccgagtatttggccaagaacttcgataagatggcccaaatacccaatttccaaaagaatctatcttcaagaaaggataaaatcgatctcttgttcgaggagaacaactttaagcctttcaagtacaacgatctgggtgccctggcctacctgggatccgaaagagccattgccaccataagaagcggtaagcggaccttttacaccggcggtggcctgatgaccttctacctgtggagaattctgtacttgtccatgattctaagcgcccgctcgagactgaaggtctttttcgactggattaagttagcctttttcaaaagggacttctttaaaggcttatag

SEQ ID NO: 185 - DNA, 1542 bp, Artificial Sequence
  source: /note="Description of Artificial Sequence: Synthetic polynucleotide"
atgctgagcaagaacctgtatagcaaccggaggctgctgaccagcacgaatacgctagtccgcttcgccagcaccagatccaccggcgtggaaaactccggggctggccctacaagcttcaagaccatgaaagtcattgaccctcagcacagcgacaagcccaacgtgctgatactgggctcggggtggggcgctatcagctttttaaagcacatcgacaccaagaagtacaacgtcagcatcatcagccctagaaagtatttcctgtttacccctctgctgccctctgcacctgtgggaaccgtggacgaaaagtcaatcattgagcccatcgttaatttcgctctcaagaaaaagggcaacgtcacctactacgaggcagaagccaccagcatcaatcccgaccggaacaccgtgaccatcaaaagcctgtctgccgttagccagctgtaccagcccgagaaccacctgggcctgcatcaggccgaacccgccgagattaagtacgactacctgatcagcgccgtgggcgccgaacccaacacctttggaatccctggggtgaccgattacggccatttcctgaaagagattcccaacagcctggaaatcagacggaccttcgccgccaacctggaaaaggctaacctgttgccaaagggtgaccccgaacggagaaggctgctgtccattgtggtcgtgggcggaggccctactggtgtggaggccgctggtgagctgcaggactacgttcaccaggacctgagaaagtttctgcccgcattggccgaggaagtgcaaattcacctggtggaagctctgcccatcgtgctgaatatgtttgagaaaaagctttcaagctacgcgcaaagccatctggaaaacacctccatcaaagtacacctgagaaccgctgtggccaaagttgaagagaagcagctgctggccaagaccaagcacgaggacggtaagataaccgaagaaactatcccctacggcaccctgatttgggccaccggcaacaaggccagacccgtaatcaccgaccttttcaagaagatccctgagcaaaacagcagcaagcggggactggcagtgaacgactttttgcaggtcaaaggcagcaacaacatcttcgccatcggcgacaacgcctttgccggcctgcctcctacagcccaagtggcccaccaagaagccgagtacctggccaagaattttgacaagatggctcaaatacccaatttccagaagaacctatcctccagaaaggataaaattgatctcttgttcgaggaaaacaactttaaacctttcaaatacaacgatctgggtgccctggcatacctgggcagcgaaagagccattgcaaccatccgttccggcaagcggaccttctacaccggtggaggcctgatgaccttctacctgtggcggatcctgtacttgtccatgatcctaagcgcacgcagcagattaaaggtctttttcgactggatcaagctggccttcttcaaaagagacttttttaagggcctgtga

SEQ ID NO: 186 - DNA, 1542 bp, Artificial Sequence
  source: /note="Description of Artificial Sequence: Synthetic polynucleotide"
atgctatcgaagaatttgtatagtaacaagcggttgctgacctcgacgaacaccatggtgcgcttcgccagcaccagatccaccggggtcgaaaactccggagctggtcctacctctttcaagaccatgaaggtcatcgacccccagcacagcgacaagcccaacgtgctgatactgggctctggctggggcgccatctcgtttctgaagcacatcgacaccaagaagtacaacgtcagcatcatcagccccagaagctacttcttattcacgcccctgctgcctagcgcacctgttggaaccgtggacgagaagtccatcatcgagcccatcgttaatttcgccctgaagaaaaagggcaacgttacctactacgaggccgaggccaccagcatcaaccccgaccggaataccgtgaccatcaagagcctgagcgccgtttcccagctataccagcctgaaaaccacctggggctgcaccaagccgaacccgctgaaattaagtacgactacctgatcagtgctgtaggcgcggagcccaacacctttggtattcctggcgtcactgattacggccacttcctgaaagagattcccaactctttggaaatacggcggacttttgccgccaatctggagaaggccaacctgttgccaaagggtgaccccgagagaagaagactgctgtccatcgtggtcgttggcggtgggcctactggtgtagaagctgctggtgagctacaggactacgtgcaccaggacctgcggaagttcctccccgccctggccgaggaagtgcagattcacctggtggaagccctgcccatcgtgctgaatatgttcgagaagaagctgagcagctacgcccaaagccacttagaaaacacctccatcaaggtacatctgagaaccgccgtggccaaggtggaagagaagcagctgctggccaagaccaagcacgaggacggcaagattaccgaagaaactatcccatacggtaccctgatttgggccaccggtaacaaggccagacccgtaatcactgacctgttcaagaagatccctgagcagaactcgtccaagagaggcttggcagtgaacgactttctgcaggtcaaaggcagcaacaacattttcgccatcggcgacaacgcatttgccgggctgcctccaaccgcccaagtggcccaccaggaagccgagtacatcgccaagaactttgacaagatggctcagatcccaaatttccaaaagaatctgtcctcacggaaggataaaatcgatctgttgttcgaggaaaacaactttaaacccttcaaatacaacgacctgggtgccctggcctacctgggcagcgaaagagccattgccaccatccgttccggcaagagaacattctacaccggcggaggcttaatgaccttctacctgtggagaatcttgtacctgtccatgatcctatctgcaagatcgagattaaaggtctttttcgactggattaagttagccttcttcaaaagagactttttcaagggcctgtga

SEQ ID NO: 187 - DNA, 1542 bp, Artificial Sequence
  source: /note="Description of Artificial Sequence: Synthetic polynucleotide"
atgctgagcaagaacctgtacagcaacaagcggctgctgaccagcacgaacacgctcgtgcgcttcgcttccaccagatccacaggggtggaaaacagcggggcaggtcccacaagcttcaagaccatgaaagtcattgacccccagcacagcgacaagcccaacgtgctgatcctgggttctgggtggggagccatttcgtttctgaagcacatcgacaccaagaagtacaacgttagcatcatcagccccagaagctatttcctgttcacccccttgctgccttctgccccagtgggaacagtagacgagaagtcaattatcgagcccatcgtgaactttgccctgaagaaaaaggggaacgtcacctactacgaggccgaggccaccagcatcaaccccgacaggaataccgtgaccataaagagcctgagcgccgtttcccagctgtaccaacccgagaaccacctgggcctgcatcaagcagagcccgctgagattaagtacgattacttaatcagtgctgtgggtgcggaacctaacacctttggtattcccggggtgaccgactacggccacttcctggaggaaattcccaactctttggaaatacggagaactttcgccgccaatctagaaaaggccaacttactgcctaagggtgatcccgaacggagaaggctgctgagcatcgtggtggtgggtggaggccccactggtgtggaggctgctggcgagctgcaggattacgtgcaccaggacctgcggaagttcctccccgccctggccgaggaagtgcagattcacctggtggaagccctgcccatcgttttgaacatgttcgagaagaagcttagctcatacgcgcagtcacacctggaaaacacctccatcaaggtgcacctgagaaccgctgtcgccaaggtggaagaaaagcagttgttggccaagaccaagcacgaagacggcaaaataaccgaagaaactatcccctacggcaccctgatttgggccaccggcaacaaggccagaccggtgatcaccgacctgttcaagaagatccccgagcaaaacagctccaagcggggactggccgtgaacgacttcctgcaggtcgagggcagcaacaacatcttcgccatcggcgacaatgcatttgccggcctgcctcctaccgcccaagtagcgcaccaggaggccgagtacttggccaagaattttgataagatggcccaaatccccaatttccagaagaacctatcttcaagaaaggataagattgatctcttgttcgaggaaaacaacttcaaacctttcaagtacaacgacttaggtgccctggcctacctgggaagcgaaagggccattgccaccataagaagcggtaagagaacattttacaccggcggtggcttaatgaccttctacctgtggcggatcctgtacctgagcatgatcctgagcgccagaagcagactgaaggtgttcttcgactggatcaagttagcatttttcaaaagagacttcttcaagggactgtga

SEQ ID NO: 188 - DNA, 1542 bp, Artificial Sequence
  source: /note="Description of Artificial Sequence: Synthetic polynucleotide"
atgctgagcaagaacttgtacagcaacaagaggctgctcaccagcacgaacaccctagtgcgcttcgctagcaccagatccaccggcgtggaaaacagcggagcaggccccacaagcttcaagaccatgaaagtcatcgacccccagcacagcgacaaaccaaacgtgctgatactgggctctgggtggggagctatttcgtttctgaagcacatcgacaccaagaagtacaacgtcagcatcatcagccctagaagctacttcttattcacgcccctgttaccctctgccccagttgggaccgtggacgagaagtcaattatcgagcccatcgtgaatttcgctctgaagaaaaagggcaacgtcacctactacgaggccgaagccacctctatcaatcccgaccggaacaccgttaccataaagagcttaagcgccgttagccagctataccagcccgaaaaccacctagggctgcaccaagccgagcccgccgaaattaagtacgactatttaatcagcgctgtaggcgcggagcctaacacctttggaattcctggcgtgactgattacggccacttcctgaaagagattcccaactctttggaaatccggcggaccttcgccgccaatctggaggaggctaacttactgccaaagggcgaccccgaacggagaaggctactgtccatcgtggtcgtgggcggagggcctactggcgtggaagctgctggcgagctgcaggactacgttcaccaggacctgcggaagtttctgcctgccttggccgaagaagtgcagattcacctggtggaagccctgcccatcgtgttgaacatgttcgagaagaagctgagctcatacgcccagagccacttagaaaacacttccatcaaggtgcacctgagaaccgccgtggccaaggttgaagaaaagcagttgttggcaaagaccaagcacgaagacggcaaaattaccgaagaaactatcccctacggcaccttgatttgggccaccggtaacaaggccagaccggtgatcaccgaccttttcaagaagatccctgagcaaaacagcagcaagcggggactggcagtgaatgactttctgcaggtcaaaggcagcaacaacatcttcgccattggcgacaacgcctttgccgggctgccacctacagcccaggtggcccaccaggaagccgaatacctggccaagaactttgataagatggcccagatacccaatttccaaaagaacctatcttcaagaaaggataaaattgacctgctgttcgaggagaacaacttcaaacccttcaagtacaacgacctgggtgccctggcctacctgggatccgaaagggccattgccaccataagaagcggcaagcggaccttctacaccggcggaggcctgatgaccttctacttatggcggatcttgtacttgtccatgatcctaagcgccagaagcagactgaaggtgttcttcgactggattaagatggcattcttcaaaagggacttcttcaagggcttatga

SEQ ID NO: 189 - DNA, 1542 bp, Artificial Sequence
  source: /note="Description of Artificial Sequence: Synthetic polynucleotide"
atgctgagcaagaatctgtatagcaacaagcggctgctgaccagcaccaatacgctcgtccgcttcgcctccaccagatccaccggggtggaaaacagcggggctggccctacatctttcaagaccatgaaagtcattgaccctcagcacagcgacaaacccaacgtgctgatcctgggctctggctggggcgccatcagctttttaaagcacatcgacaccaagaagtacaacgtttccatcatctctcccagaagctatttcctgttcacgcctctgttaccttctgcaccagtggggaccgtagacgaaaagtccatcattgagcccatcgtgaatttcgccctgaagaaaaagggcaacgttacctactacgaggccgaggccacctctatcaaccccgaccggaataccgtgaccatcaagaacttaagcgccgtgagccagctgtaccaacccgagaaccacctagggctgcaccaggcagaacccgccgagattaagtacgattatctgatcagtgccgtgggcgccgagcctaacacctttggtattcctggcgtgactgactacggtcacttcctgaaggagatccccaactctctggaaatccggagaaccttcgccgccaacctggaaaaggccaacctgctgccaaagggcgaccccgagcggagaaggctgctgagcatcgtggtcgtgggtggtggccccactggtgtagaggctgctggcgaactgcaggattatgtgcaccaggacctgcggaagtttctccccgcactggccgaggaagtccagattcacctggtggaagctctgcccatcgttctgaacatgttcgagaaaaagctgagcagctacgcgcaaagccatctggaaaacacttccatcaaagtacacctgagaaccgctgtggccaaggtggaagagaagcaactgctggccaagaccaagcacgaggacggcaaaattaccgaagaaaccattccctacggcaccttgatttgggccacgggcaacaaggccagacccgtgatcaccgaccttttcaagaagatccctgagcagaactcgtccaagcggggcctggcagtgaacgacttcctgcaggtggagggcagcaacaacatcttcgccattggcgacaatgcatttgctggcctgcctcctaccgcccaggtggcgcaccaggaggccgagtacctggccaagaattttgacaagatggctcaaatccccaatttccagaagaatctgtcctcccggaaggataagatcgacctcctgttcgaggagaacaacttcaagcccttcaaatacaacgatctgggtgccctggcatacctgggctccgaaagagccattgcaaccatccgtagcggcaagagaaccttttacaccggtggtggcttaatgaccttctacttatggcggatcctgtacctgtccatgatcctgagcgccagatcgagattaaaggtcttcttcgactggatcaaactggcatttttcaagagagacttcttcaagggactgtag

SEQ ID NO: 190 - DNA, 1542 bp, Artificial Sequence
  source: /note="Description of Artificial Sequence: Synthetic polynucleotide"
atgctaagcaagaacttgtatagtaacaagcggctgctcacctcgacgaatacgctagtccgcttcgcttccaccagatccaccggggtggaaaactccggggctggccctacctctttcaagaccatgaaagtcatcgaccctcagcacagcgacaagcccaacgtgctgatcctgggctctgggtggggcgccatcagctttctgaagcacattgacaccaagaagtacaacgttagcatcatctctcctagaagctacttcctgtttacgcctctgttacccagcgccccagttggaacagtggacgagaagtccattattgagcccatcgtgaacttcgctctcaagaaaaagggcaacgttacctactatgaggcagaggccacctctatcaatcccgaccggaacaccgttaccatcaagagcctgagcgccgttagccagctgtaccagcccgaaaaccatctggggctgcaccaagccgagcctgccgagattaagtacgactacctgatcagtgccgtaggcgcggagcccaacacctttggaattcccggggtgactgactacggtcacttcctggaggagattcccaacagcttggaaatacggagaacctttgccgccaacctagaaaaggctaacctgctgcctaagggcgaccccgagcggagaagactgctgagcatcgtggtggttggtggaggccccacaggcgtagaagccgctggtgagctgcaggactacgtgcaccaggacctgagaaagttcctccccgccttggccgaggaagtgcaaattcacctggtggaagccctgcccatcgttttgaatatgttcgagaagaagctgtcaagctacgcccaatcacacttagaaaacacttcgatcaaagtacatctgagaacggccgtggccaaggtggaagagaagcagctgctggccaagaccaagcacgaggacggcaaaattaccgaggaaaccatcccatacggtaccctgatttgggccacgggtaacaaggcaagaccggtgatcactgacctgttcaagaagatccccgagcagaacagcagcaagagaggattggcagtgaacgacttcctgcaggtcaaaggcagcaacaacatcttcgccatcggtgacaacgcctttgccgggctgccaccaacagcccaggtggcccaccaggaggccgaatacttggccaagaatttcgacaaaatggctcagatcccaaatttccagaagaacctatcctccagaaaggataagattgacctgctgttcgaggagaacaacttcaagcccttcaagtacaacgacctgggcgccctggcctacctgggatccgaaagagccattgccaccatcagaagcggtaagcggaccttttacaccggtggaggcctgatgaccttctacctgtggcggattctgtacctgagcatgatcctaagcgcccgcagcagactgaaggtcttcttcgactggattaaattagccttcttcaaaagggactttttcgagggcttatga

SEQ ID NO: 191 - DNA, 1542 bp, Artificial Sequence
  source: /note="Description of Artificial Sequence: Synthetic polynucleotide"
atgctgtcgaagaatttgtacagcaacaagcggctgctcaccagcacgaacaccctcgtgagattcgctagcaccagatccaccggcgtggaaaacagcggggcaggccccacctctttcaagaccatgaaggtcattgacccccagcacagcgacaagcccaacgtgctgatactgggttctggctggggagctatcagctttttaaagcacatcgacaccaagaagtacaacgtctccatcatcagccccagaagctacttcttattcacgcctttgctgccctctgcacctgttggaaccgtagacgagaagtcaatcattgagcccatcgtgaatttcgccctcaagaaaaaggggaacgtcacctactatgaggcagaagccaccagcatcaaccccgaccggaataccgtgaccatcaagtcactgagcgccgtgagccagctataccagcccgaaaaccatctagggctgcaccaggccgagcccgccgagattaagtacgactatctgatcagcgctgtaggcgcggaacccaacacatttggaatccccggcgtcactgactacggtcatttcctgaaagaaatccccaactctttggaaatccggcggacttttgccgccaacctagaagaggccaacctgttgcctaagggcgaccccgagagaagaaggctactgtccattgtggtggtgggcggtgggcccacaggcgtggaagctgctggcgaactgcaggattacgtgcaccaggacctgagaaagtttctccctgccttggccgaagaagtccagattcacctggtggaagccctgcccatcgtgttgaatatgtttgagaaaaagctgagcagctacgcgcaaagccacttagaaaacacctccatcaaggtgcacctgagaacggctgtggccaaagtggaagaaaagcagctgctggccaagaccaagcacgaggacggcaagataaccgaggaaaccatcccctacggtaccctgatttgggccaccggtaacaaggccagaccggtgatcactgacctgttcaagaagatccctgagcagaactcgtccaagcggggactggccgtgaatgacttcctgcaggtgaaaggcagcaacaacatcttcgccatcggcgacaatgcctttagcggcctgccacctaccgcccaagtggcccaccaggaagccgagtacctggccaagaacttcgataaaatggctcaaataccaaatttccaaaagaatctgtcctcccggaaggataaaattgacctcttgttcgaggaaaacaacttcaagcctttcaaatacaacgatctgggcgccttagcatacctgggcagcgaaagagccattgcaaccatccgtagcggtaagagaaccttttacaccggcggaggcctgatgaccttctacctgtggcggattctgtacttgagcatgatcctgagcgccagaagcagactgaaggtgttcttcgactggatcaagctggcattcttcaagagagactttttcaagggcttatga

SEQ ID NO: 192 - DNA, 1542 bp, Artificial Sequence
  source: /note="Description of Artificial Sequence: Synthetic polynucleotide"
atgctgtcgaagaacctgtatagcaacaagcggctgctgaccagcaccaacacgctagtcagattcgcctccaccagatccacaggcgtggaaaacagcggagctggtcccacctctttcaagaccatgaaggtcatcgaccctcagcacagcgacaagcccaacgtgctgatcctgggctcgggctggggcgctattagctttctgaagcacatcgacaccaagaagtacaacgttagcatcatcagccccagaagctatttcttattcacgcccctgttacccagcgccccagtggggaccgtggacgagaagtccattatcgagcccatcgtgaattttgctctgaagaaaaagggcaacgtcacctactacgaggcagaagccaccagcatcaaccccgaccggaacaccgttaccataaaaagcttatctgccgtgtcccagctgtaccaacccgagaaccacctggggctgcaccaagcagagcccgccgagattaagtacgattacttaatcagcgccgtaggtgccgaacctaacacatttggaatccccggcgtgaccgattacggccacttcctgaaagagattcccaactctctggaaatccggagaacttttgccgccaacctagagaaggctaacctgttgcctaagggtgaccccgaaagaagaaggctactgtccattgtggtggttggcggtgggcctacaggtgtggaagccgctggcgagctgcaggattacgtgcaccaggacctgagaaagttcctgcccgcactggccgaagaagtccaaattcacctggtggaagccctgcccatcgttctgaacatgttcgagaagaagctgagctcatacgcgcagtcacacctggaaaacacctcgatcaaggtgcatctgagaaccgctgtcgccaaagttgaagagaagcagttgttggccaagaccaagcacgaagacggcaagataaccgaagaaactatcccctacggcaccctgatttgggccacgggcaacaaggcaagaccggtaatcactgacctgttcaagaagatccccgagcaaaacagcagcaagcggggcctggcagtgaacgacttcttgcaggtcaaaggcagcaacaacatcttcgccattggcgacaacgcatttgccgggctgccacctaccgcccaggtggcgcaccaggaggccgaatacatcgccaagaactttgacaagatggcccagatccccaatttccagaagaacctgtcctcaagaaaggataagattgacctcctgttcgaggaaaacaacttcaagcctttcaagtacaacgatttaggcgccttagcatacctgggcagcgaaagagccattgccaccatccgtagcggcaagcggaccttttacaccggtggaggcttaatgaccttctacctgtggcggatcctgtacatgtccatgattctgagcgccagatcgagactgaaggtgtttttcgactggattaagctggccttcttcaaaagggacttctttaagggcttatga

SEQ ID NO: 193 - DNA, 1542 bp, Artificial Sequence
  source: /note="Description of Artificial Sequence: Synthetic polynucleotide"
atgctgtcgaagaacttgtatagtaaccggcggttgctcacctcgaccaacacgctagtgcgcttcgcttccaccagatccacaggcgtggaaaacagcggggctggccccacatcttttaagaccatgaaggtcatcgaccctcagcacagcgacaaacccaacgtgctgatactgggttctggctggggcgccatcagctttctgaagcacatcgacaccaagaagtacaacgtctccatcatcagccctagaagctatttcctgttcacgcccctgttaccttctgccccagttgggaccgtagacgagaagtcaattatcgagcccatcgtgaattttgccctgaagaaaaagggcaacgttacctactatgaggccgaagccacctctatcaatcccgacaggaacaccgtgaccataaaaagcctgagcgccgttagccagctgtaccagcctgaaaaccacctagggctgcatcaagccgaacctgctgaaattaagtacgactacctgatcagcgccgtaggcgccgagcctaacacctttggaattcctggggtcactgattacggccatttcctgaaggagatccccaacagcctggaaatacggagaaccttcgccgccaacctagaagaggctaacctgctgcctaagggtgatcccgaacggagaaggctgctgtccatcgtggtcgtgggtggtgggcccacaggcgtggaagccgctggcgagctgcaggactacgtgcaccaggacctgcggaagttcctgcctgccctggccgaggaagtgcagattcacctggtcgaagctctgcccatcgttctgaacatgtttgagaagaagctgagctcatacgcccagagccacctggaaaacacctcgatcaaggtgcacctgagaacggctgtcgccaaggttgaagagaagcaactgctggccaagaccaagcacgaggacggcaagattaccgaggaaactatcccctacggcaccttgatttgggccacgggcaacaaggcaagacccgtgatcaccgaccttttcaagaagatccccgagcagaacagcagcaagagaggactggcagtgaacgacttcttgcaggtcaaaggcagcaacaacatcttcgccatcggtgacaacgcatttgctggcctgcctcctaccgcccaggtggcccaccaggaggccgagtacttggccaagaatttcgataagatggctcagatacccaatttccagaagaatctgtcctcccggaaggataagatcgatctgctgttcgaggaaaacaacttcaagcctttcaagtacaacgacctgggcgccttagcctacctgggatccgaaagggccattgccaccatacgtagcggcaagcggacattctacaccggcggaggcctgatgaccttctacttatggcggattctgtacttgtccatgatcctgagcgcacgcagcagactgaaggtgtttttcgactggatcaaattagcattcttcaaaagggacttcttcaaaggcctgtga

SEQ ID NO: 194 - DNA, 1542 bp, Artificial Sequence
  source: /note="Description of Artificial Sequence: Synthetic polynucleotide"
atgctatcgaagaacctgtacagcaacaagaggttgctgacctcgaccaacaccctcgtgagattcgccagcaccagatccaccggcgtcgaaaactccggggcaggtcccacctctttcaagaccatgaaagtcatcgacccccagcacagcgacaagccaaacgtgctgatactgggctctggctggggagccattagctttctgaagcacattgacaccaagaagtacaacgtttccatcatctctcctagaagctacttcttattcacgcccctgatgccttctgccccagtgggaacagtggacgaaaagtccatcatcgagcccatcgtgaatttcgctctgaagaaaaaggggaacgtcacctactatgaggccgaggccacctctatcaaccccgacaggaacaccgttaccatcaagagcctgagcgccgtgtcccagctataccagcccgaaaaccacctgggcctgcaccaagccgaacctgccgagattaagtacgactacctgatcagtgccgtgggcgccgagcccaacacatttggaattcccggggtcactgattacggccacttcctggaggagatccccaactctctggaaatccggcggaccttcgccgccaacctggaaaaggccaacctgttgccaaagggcgaccccgaaagaagaaggctgctgtccatcgtggtggtgggtggagggcccactggtgtggaagccgctggcgagctgcaggactatgttcaccaggacctgcggaagtttctgcccgccctggccgaggaagtgcaaattcacctggtcgaagccctgcccatcgtgctgaacatgtttgagaagaagctgagcagctacgcccagtcacacttagaaaacacctcgatcaaggtacacctgagaaccgctgtggccaaagtggaagaaaagcaattgctggcaaagaccaaacacgaggacggtaagataaccgaggaaaccattccctacggtaccctgatttgggccaccggcaacaaggcaagacccgtgatcaccgacctgttcaagaagattcccgagcagaactcgagcaagagaggactggcagtgaacgactttctgcaggtgaaaggcagcaacaacatcttcgccatcggtgacaacgcatttgctggcttgccacctacagcccaagtggcccaccaagaagccgaatatttggccaagaatttcgacaagatggctcagatacccaatttccagaagaacctgtcctcccggaaggataagattgatctgttgttcgaggagaacaactttaaacccttcaagtacaacgatttaggtgccctggcatacctgggcagcgaaagagccattgcaaccatacgttccggtaagcggacattctacaccggtggtggcctgatgaccttctacctgtggcggatcctgtacttgtccatgattctgagcgccagaagcagactgaaggtgtttttcgactggattaagttagcctttttcaagagggacttttttaagggcctgtga

SEQ ID NO: 195 - DNA, 1542 bp, Artificial Sequence
  source: /note="Description of Artificial Sequence: Synthetic polynucleotide"
atgctgtcgaagaacctgtacagcaacaagaggttgctcaccagcaccaacaccctcgtcagattcgctagcaccagatccaccggcgtcgaaaactccggggctggtcccacaagctttaagaccatgaaggtcattgacccccagcacagcgacaaacccaacgtgctgatcctgggctctgggtggggcgctattagctttttaaagcacattgacaccaagaagtacaacgtcagcatcatcagccccagaagctatttcttattcacccccctgttaccttctgccccagtgggaaccgtggacgaaaagtcaattattgagcccatcgttaactttgctctgaagaaaaagggcaacgtcacctactacgaggccgaggccaccagcatcaaccccgacaggaataccgttaccatcaagagcttatctgccgttagccagctgtaccagcccgaaaaccatctgggcctgcaccaggccgagcccgccgagattaagtacgactacttaatcagtgccgtgggcgcggaacccaacacatttggaattcccggggtcaccgactacggccacttcctgaaggaaatccccaacagcctggaaatccggcggaccttcgccgccaatctggaaaaggccaacctgttgcctaagggcgaccccgagcggagaaggctgctgagcattgtcgtcgtgggcggagggcctactggtgtggaggctgctggcgagctgcaggactatgtgcaccaggacctgcggaagtttttccccgccttggccgaagaagtgcaaattcacctggtcgaagctctgcccatcgttctgaacatgttcgagaagaagctgtcatcatacgcccagtcacacttagaaaacacttccatcaaggtgcacctgagaacggccgtggccaaagttgaagagaagcaactgctggccaagaccaagcacgaggacggcaagataaccgaggaaaccatcccctacggtactctgatttgggccaccggtaacaaggcaagacccgtaatcactgacctgttcaagaagatccccgagcagaacagcagcaagagaggattggccgtgaacgactttttgcaggtcaaaggcagcaacaacatcttcgccatcggcgacaatgcctttgccggcttgcctcctacagcccaggtagcgcaccaggaggccgaatatctggccaagaatttcgacaaaatggcccagatacccaatttccagaagaacctatcttccagaaaggataagatcgatctcttgttcgaggaaaacaacttcaagcctttcaaatacaacgatttaggtgccttagcctacctgggcagcgaaagagccattgccaccatacgttccggtaagcggacattttacaccggtggtggcctgatgaccttctacttatggagaatcttgtacctgagcatgatcctatctgccagaagcagactgaaggtgttcttcgactggatcaaactggccttcttcaaaagggacttcttcgagggattatag

SEQ ID NO: 196 - DNA, 1542 bp, Artificial Sequence
  source: /note="Description of Artificial Sequence: Synthetic polynucleotide"
atgctgagcaagaacctgtacagcaacaagaggctgctgaccagcaccaacacgctcgtccgcttcgcctccaccagatccaccggggtggaaaacagcggagcaggccctacctcttttaagaccatgaaggtcatcgacccccagcacagcgacaagcccaacgtgctgatcctgggctctggctggggagccatctcgtttctgaagcacatcgacaccaagaagtacaacgtttccatcatcagccccagaagctatttcttatttacgcctctgctgcctagcgcccctgtggggacagtggacgaaaagtccattatcgagcccatcgtgaactttgctctcaagaaaaaggggaacgtcacctactatgaggcagaggccaccagcatcaatcccgaccggaacaccgttaccatcaagagcctgagcgccgtgtcccagctataccaacccgagaaccacctgggcctgcatcaagcagagcccgctgaaattaagtacgattacttaatcagcgctgtaggcgccgagcctaacacatttggaatccccggggtgaccgattacggtcacttcctgaaggaaattcccaacagcctggaaatcagacggaccttcgccgccaacctagagaaggccaacttattgcctaagggtgaccccgaaagaagaagactactgagcatcgtcgtcgtgggcggaggccccactggtgtggaggctgctggcgagctacaggactacgttcaccaggacctgagaaagttcctgcccgccctggccgaagaagtccagattcacctggtggaagccctgcccatcgtgctgaatatgtttgagaaaaagctgtcaagctacgcccagagccacctggaaaacacctccatcaaagtacatctgagaaccgccgtggccaaggttgaagagaagcagttgctggccaagaccaagcacgaggacggcaagataaccgaagaaaccatcccctacggcaccctgatttgggccaccggcaacaaggccagacccgtgatcactgacctgttcaagaaaattcccgagcaaaactcgagcaagcggggcttggcagtgaacgacttcttgcaggtcaaaggcagcaacaacattttcgccattggcgacaacgcctttgccggcctgcctccaacagcccaagtggcgcaccaggaggccgaatacctggccaagaatttcgataaaatggcccagataccaaatttccaaaagaacctatcctcccggaaggataagatcgatctgctgttcgaggaaaacaactttaagcctttcaagtacaacgatctgggtgccttagcatacctgggaagcgaaagagccattgccaccatcagatccggtaagagaacattctacaccggcggtggcttaatgaccttctacctgtggagaatcctgtacatgtccatgatcctgtctgcaagatcgagattaaaggtgtttttcgactggatcaagatggccttcttcaagagggacttcttcaaaggactgtag

SEQ ID NO: 197 - DNA, 1542 bp, Artificial Sequence
  source: /note="Description of Artificial Sequence: Synthetic polynucleotide"
atgctatcgaagaacctgtacagtaacaagaggttgctgaccagcacgaacacgatggtgcgcttcgcctccaccagatccaccggggtcgaaaactccggggctggccctacctctttcaagaccatgaaagtcatcgacccccagcacagcgacaagcccaacgtgctgatcctgggctctgggtggggcgctatctcgtttctgaagcacattgacaccaagaagtacaacgttagcatcatcagccccagaaagtacttcctgtttacccctttgctgccctctgcccctgttggaaccgtagacgagaagtcaattatcgagcccatcgttaattttgctctgaagaaaaaggggaacgtcacctactacgaggcagaggccaccagcatcaaccccgaccggaacaccgtgaccataaagtcactgtctgccgtttcccagctgtaccagcccgaaaaccacctgggcctgcaccaagccgaacccgccgaaattaagtacgactacctgatcagcgctgtgggtgccgagcccaacacctttggaattcccggggtcaccgactacggccacttcctgaaggagattcccaactctctggaaatcagacggacttttgccgccaatctagagaaggccaacttattgcctaagggcgaccccgaacggagaagactgctgagcatcgtggtggtgggcggaggccccacaggtgtggaggctgctggcgaactgcaggactacgtgcaccaggacctgagaaagtttctgcctgccctggccgaagaagtgcaaattcacctggtggaagctctgcccatcgtgttgaacatgttcgagaagaagctgtcaagctacgcccaaagccacttagaaaacacttccatcaaagtacacctgagaaccgccgtggccaaggttgaagagaagcagctgctggccaagaccaagcacgaggacggcaagataaccgaagaaaccatcccatacggtactctgatttgggccaccggtaacaaggccagacccgtgatcactgacctgttcaagaagattcccgagcaaaacagctccaagcggggcttggccgtgaacgacttcctgcaggtgaaaggcagcaacaacatcttcgccatcggcgacaacgcatttgccgggttgcctcctaccgcccaggtggcccaccaggaggccgaatacctggccaagaactttgataaaatggctcaaatacccaatttccagaagaacctatcctcacggaaggataaaatcgacctgctgttcgaggaaaacaacttcaagcccttcaagtacaacgacctgggtgccctggcctacctgggcagcgaaagagccattgccaccataagaagcggtaagagaacattctacaccggtggtggcttaatgaccttctacttatggagaattttgtacctgtccatgattctatctgcacgcagcagattaaaggtgtttttcgactggatcaagttagcatttttcaaaagggacttctttaaaggcctgtga

SEQ ID NO: 198 - DNA, 1542 bp, Artificial Sequence
  source: /note="Description of Artificial Sequence: Synthetic polynucleotide"
atgctgtcgaagaacttgtacagcaaccggaggttgctgaccagcaccaatacgctcgtccgcttcgcttccaccagatccaccggcgtggaaaactccggggctggtcctacctctttcaagaccatgaaagtcatcgaccctcagcacagcgacaaacccaacgtgctgatactgggttcggggtggggcgctatcagctttctgaagcacatcgacaccaagaagtacaacgtcagcatcatcagccccagaagctacttcctgtttacccccttgctgccctctgcccctgttggaaccgtggacgaaaagtccatcatcgagcccatcgtgaacttcgccctcaagaaaaagggcaacgttacctactatgaggccgaagccaccagcatcaatcccgaccggaataccgttaccataaaaagcctgagcgccgtttcccagctgtaccagcctgagaaccacctagggctgcaccaggcagaacctgctgaaattaagtacgactacctgatcagtgctgtgggcgccgagcctaacacctttggtatccccggggtgaccgactacggccacttcctgaaggagattcccaactctttggaaatcagacggaccttcgccgccaatctagagaaggccaacctgctgcctaagggtgaccccgaaagaagaaggctgctgagcatcgtggtcgtgggcggagggcccacaggcgtggaggctgctggtgagctacaggattacgtgcaccaggacctgcggaagttcctccctgccctggccgaagaagtgcaaattcacttggtggaagccctgcccatcgttctgaatatgttcgagaagaagctttcatcatacgcccagtcacacctggaaaacacctcgatcaaggtacacctgagaacggctgtcgccaaagtggaagaaaagcaactgctggccaagaccaagcacgaggacggcaagattaccgaggaaaccatcccatacggcaccttgatttgggccaccggcaacaaggcaagacccgtgatcaccgacctgttcaagaaaatccccgagcaaaacagctccaagagaggcctggccgtgaatgacttcctgcaggtgaaaggcagcaacaacatcttcgccatcggtgacaatgcatttgctggcttgcctccaaccgcccaagtggcgcaccaggaagccgaatacttggccaagaacttcgacaaaatggcccagatccccaatttccagaagaatctgtcttccagaaaggataagatcgacctcctgttcgaggaaaacaacttcaaacccttcaagtacaacgatctgggcgccctggcctacctgggatccgaaagagccattgccaccataagaagcggtaagcggaccttttacaccggtggtggcttaatgaccttctacttatggcggatcctgtacttgagcatgattctgtctgcccgctcgagactgaaggtgttcttcgactggattaagctggccttcttcaagagagactttttcgagggcctgtga

SEQ ID NO: 199 - DNA, 1542 bp, Artificial Sequence
  source: /note="Description of Artificial Sequence: Synthetic polynucleotide"
atgctgtcgaagaatctgtacagtaacaagaggctgctgaccagcaccaacaccatggtccgcttcgcctccaccagatccacaggcgtcgaaaacagcggggctggccccaccagcttcaagaccatgaaggtcatcgacccccagcacagcgacaagcccaacgtgctgatactgggctcggggtggggcgctattagctttctgaagcacattgacaccaagaagtacaacgtcagcatcatctctcccagaagctacttcttattcacccccctgctgcctagcgcccctgtgggaacagtagacgagaagtccatcatcgagcccatcgttaacttcgccctcaagaaaaagggcaacgtcacctactatgaggccgaggccacctctatcaaccccgaccggaacaccgtgaccataaagagcctgtctgccgttagccagctgtaccaacctgagaaccatctaggcctgcatcaggccgagcctgctgagattaagtacgattatctgatcagcgccgtaggcgccgagcccaacacctttggaatccccggggtcactgattacggtcatttcctgaaggagatccccaacagcttggaaatcagacggacctttgccgccaacctagaaaaggccaacctgctgccaaagggcgaccccgagcggagaagactactgagcattgtcgtcgtgggcggtgggcccacaggtgtagaagccgctggtgaactgcaggattatgtgcaccaggacctgcggaagttcctgcccgcactggccgaggaagtccagattcacctggtggaagccctgcccatcgttttgaatatgttcgagaaaaagctgagcagctacgcccagtcacatttagaaaacacctcgatcaaggtgcacctgagaaccgccgtggccaaagtggaagaaaagcagctgttggcaaagaccaagcacgaagacggcaaaattaccgaggaaactattccatacggcaccctgatttgggccaccggcaacaaggcaagaccggtgatcactgaccttttcaagaaaatccccgagcagaactcgtccaagagaggcctggccgtgaatgacttcttgcaggtgaaaggcagcaacaacattttcgccattggcgacaatgcctttgccgggttgcctcctacagcccaggtggcccaccaggaggccgagtacatcgccaagaattttgataagatggctcaaataccaaatttccagaagaacctgtcttccagaaaggataagatcgatctgttgttcgaggaaaacaacttcaagcccttcaaatacaacgacttaggtgccctggcctacctgggcagcgaaagggccattgccaccataagatccggtaagcggaccttctacaccggcggaggcctgatgaccttctacttatggagaatcctgtacttgtccatgattctgtctgccagaagcagactgaaggtgtttttcgactggattaaattagccttcttcaagagggactttttcaagggcttatag

SEQ ID NO: 200 - DNA, 1542 bp, Artificial Sequence
  source: /note="Description of Artificial Sequence: Synthetic polynucleotide"
atgctgtcgaagaacctgtatagtaacaagaggctgctcacctcgacgaacaccctcgtgcgcttcgccagcaccagatccaccggcgtcgaaaacagcggggctggtcctacctcttttaagaccatgaaggtcatcgacccccagcacagcgacaaaccaaacgtgctgatcctgggctctggctggggagccatcagctttctgaagcacattgacaccaagaagtacaacgtctccatcatctctcccagaagctacttcctgttcacccctctgctgcccagcgcccctgtgggaaccgtggacgagaagtcaatcatcgagcccatcgttaactttgccctgaagaaaaaggggaacgttacctactatgaggccgaggccacctctatcaaccccgacaggaacaccgtgaccatcaagtcactgagcgccgttagccagctataccagcctgagaaccatctaggcctgcaccaggccgaacccgccgagattaagtacgactacttaatcagcgccgtgggcgcggaacctaacacatttggaatccctggcgtgaccgactacggtcacttcctgaaagagatccccaacagcctggaaatccggcggacttttgccgccaatctagaagaggctaacctgttgcctaagggcgaccccgagcggagaagactactgagcattgtggtcgttggcggagggcccacaggtgtagaagctgctggcgagctacaggattatgtgcaccaggacctgcggaagtttctgcctgccttggccgaggaagtccagattcacctggtcgaagctctgcccatcgttctgaatatgtttgagaagaagctgtcatcatacgcgcaatcacacctggaaaacacttcgatcaaggtacatctgagaacggccgtcgccaaagtggaagagaagcagctgttggcaaagaccaaacacgaggacggcaaaattaccgaagaaactatcccatacggtaccttgatttgggccaccggcaacaaggccagacccgtaatcactgacctgttcaagaaaatccccgagcagaacagcagcaagagaggactggccgtgaacgacttcttgcaggtcaaaggcagcaacaacatcttcgccatcggtgacaatgcatttagcggcctgccaccaacagcccaagtagcccaccaagaggccgagtacctggccaagaactttgataaaatggctcagatccccaatttccaaaagaacctgtcttcacggaaggataagattgatctcttgttcgaggaaaacaacttcaagcccttcaagtacaacgatctgggtgccctggcatacctgggaagcgaaagagccattgccaccataagaagcggcaagcggacattttacaccggcggaggcctgatgaccttctacctgtggcggattctgtacctgagcatgattctatctgccagatcgagactgaaggtgttcttcgactggatcaaactggcctttttcaagagggacttcttcaagggcctgtga

SEQ ID NO: 201 - DNA, 1542 bp, Artificial Sequence
  source: /note="Description of Artificial Sequence: Synthetic polynucleotide"
atgctgtcgaagaatctgtacagcaacaagcggctgctgaccagcaccaatacgctcgtgcgcttcgcttccaccagatccacaggcgtggaaaactccggggcaggtcctaccagctttaagaccatgaaagtcattgaccctcagcacagcgacaaacccaacgtgctgatcctgggctcgggctggggcgctatcagctttttaaagcacatcgacaccaagaagtacaacgtcagcatcatcagccctagaagctatttcctgttcacccccctgctgcctagcgccccagtggggacagtggacgagaagtcaatcatcgagcccatcgttaattttgccctgaagaaaaagggcaacgtcacctactatgaggcagaagccacctctatcaatcccgaccggaacaccgttaccatcaagagcctgagcgccgtgtcccagctgtaccagcccgaaaaccatctgggcctgcatcaagccgagcctgctgagattaagtacgattacttaatcagtgccgtaggcgccgaacctaacacctttggtattcctggcgtgaccgactacggtcacttcctgaaagagatccccaacagcctggaaatcagacggaccttcgccgccaatctggaaaaggccaacttactgccaaagggcgaccccgaacggagaagactactgagcatcgtggtcgtgggtggagggcccactggtgtagaggctgctggcgaactgcaggattacgttcaccaggacctgcggaagttcttccctgccctggccgaggaagtgcagattcacttggtcgaagccctgcccatcgtgctgaacatgttcgagaagaagcttagctcatacgcccagagccacctggaaaacacctccatcaaggtgcacctgagaaccgccgtcgccaaagttgaagagaagcaactgttggccaagaccaagcacgaggacggtaagataaccgaggaaaccatcccctacggtaccttgatttgggccaccggcaacaaggcaagacccgtaatcactgaccttttcaagaaaatccctgagcagaacagcagcaagagaggcttggcagtgaacgactttctgcaggtcaaaggcagcaacaacattttcgccatcggtgacaatgcctttgctggcctgccaccaacagcccaggtggcccaccaggaggccgagtacctggccaagaatttcgacaaaatggctcaaatccccaatttccagaagaacctatcctccagaaaggataaaatcgacctgctgttcgaggagaacaacttcaagcccttcaaatacaacgatttaggcgccctggcctacctgggcagcgaaagagccattgcaaccataagatccggtaagagaaccttctacaccggcggaggcctgatgaccttctacttatggagaattttgtacctgtccatgattctgtctgcacgcagcagactgaaggtctttttcgactggatcaagatggccttcttcaaaagagacttcttcaaaggcctgtag

SEQ ID NO: 202 - DNA, 1542 bp, Artificial Sequence
  source: /note="Description of Artificial Sequence: Synthetic polynucleotide"
atgctgtcgaagaacctgtacagtaacaagcggttgctgaccagcacgaacaccctagtgcgcttcgcttccaccagatccacaggcgtcgaaaactccggagctggccccacatctttcaagaccatgaaggtcatcgaccctcagcacagcgacaagcccaacgtgctgatactgggctcggggtggggcgccatcagctttttaaagcacattgacaccaagaagtacaacgtctccatcatctctcccagaagctatttcctgttcacgcccttgttacccagcgcccctgttggaaccgtggacgagaagtccatcattgagcccatcgtgaacttcgctctcaagaaaaaggggaacgttacctactatgaggcagaagccaccagcatcaaccccgacaggaataccgttaccataaagtcattatctgccgttagccagctataccaacccgaaaaccatctggggctgcatcaggccgaacccgccgagattaagtacgactatctgatcagcgccgtaggcgcggagcctaacacctttggaatccctggcgtgaccgattacggccatttcctgaaagagatccccaacagcttggaaatccggcggaccttcgccgccaacctggaagaggctaacctgttgccaaagggtgatcccgagagaagaaggctgctgtccattgtggtcgtgggtggtggccccacaggtgtggaagctgctggtgaactgcaggactatgttcaccaggacctgagaaagtttctgcccgccctggccgaggaagtgcagattcacctggtggaagctctgcccatcgtgctgaacatgttcgagaagaagcttagcagctacgcccaatcacatttagaaaacacttcgatcaaagtgcacctgagaacggccgtggccaaggtggaagaaaagcagctgctggccaagaccaaacacgaggacggcaaaattaccgaggaaaccattccctacggtaccctgatttgggccaccggcaacaaggccagaccggtgatcactgacctgttcaagaagattcctgagcaaaacagctccaagcggggcctggccgtgaacgacttcctgcaggtcgagggcagcaacaacattttcgccatcggcgacaacgcctttgctgggctgcctccaacagcccaggtagcgcaccaggaggccgagtacttggccaagaacttcgacaagatggcccagatccccaatttccaaaagaacctatcctcccggaaggataaaattgacctcctgttcgaggagaacaacttcaaacccttcaagtacaacgacttaggcgccttagcatacctgggcagcgaaagagccattgccaccataagaagcggtaagagaaccttttacaccggcggtggcctgatgaccttctacctgtggcggatcctgtacctgagcatgattctaagcgcccgctcgagattaaaggtcttcttcgactggattaaactggcctttttcaaaagggacttcttcaaaggcctgtag

SEQ ID NO: 203 - DNA, 1542 bp, Artificial Sequence
  source: /note="Description of Artificial Sequence: Synthetic polynucleotide"
atgctgtcgaagaatttgtatagtaacaagcggttgctgaccagcaccaataccctagtgcgcttcgccagcaccagatccaccggcgtggaaaactccggggctggtcccacatctttcaagaccatgaaagtcatcgaccctcagcacagcgacaaacccaacgtgctgatcctgggctcggggtggggagccatctcgtttctgaagcacatcgacaccaagaagtacaacgtcagcatcatctctcctagaagctatttcctgtttacgcctctgctgcctagcgcaccagtgggaaccgtggacgagaagtcaatcatcgagcccatcgtgaacttcgccctcaagaaaaagggcaacgttacctactacgaggccgaagccaccagcatcaatcccgacaggaacaccgtgaccatcaaaagcctgagcgccgtgtcccagctgtaccaacccgagaaccatctagggatgcaccaggccgaacccgccgaaattaagtacgattatctgatcagcgctgtaggcgccgagcctaacacatttggaatccccggggtgaccgactacggtcatttcctgaaggagatccccaacagcttggaaatacggcggactttcgccgccaatctagagaaggccaacctgttgcctaagggcgatcccgaaagaagaaggctgctgagcatcgtggtcgttggtggaggccccacaggtgtagaggctgctggtgaactgcaggactatgtgcaccaggacctgagaaagttcctgcccgccctggccgaagaagtgcagattcacttggtggaagccctgcccatcgtgttgaacatgttcgagaagaagctgagctcatacgcgcagagccacttagaaaacacttccatcaaagtacacctgagaaccgctgtggccaaggttgaagagaagcaattgctggcaaagaccaaacacgaagacggcaagattaccgaggaaactattccctacggcactttgatttgggccaccggcaacaaggccagaccggtgatcactgacctgttcaagaagatccctgagcagaacagcagcaagcggggcctggccgtgaatgacttcctgcaggtgaaaggcagcaacaacattttcgccatcggcgacaacgcatttgctggcttgcctccaacagcccaggtggcccaccaggaggccgagtacctggccaagaactttgataagatggctcagatccccaatttccagaagaacctatcctccagaaaggataaaattgacctgctgttcgaggaaaacaacttcaaacccttcaagtacaacgatctgggcgccttagcctacctgggcagcgaaagagccattgcaaccataagaagcggtaagagaacattctacaccggtggaggcctgatgaccttctacctgtggagaatcctgtacctgagcatgattctatctgcccgctcgagactgaaggtcttcttcgactggatcaagctggcattcttcaaaagagactttttcgagggcctgtag

SEQ ID NO: 204 - DNA, 1542 bp, Artificial Sequence
  source: /note="Description of Artificial Sequence: Synthetic polynucleotide"
atgctaagcaagaacttgtacagcaacaagaggctgctgacctcgaccaacaccctcgtgcgcttcgcctccaccagatccaccggcgtcgaaaacagcggagctggtcctacaagctttaagaccatgaaagtcatcgacccccagcacagcgacaaacccaacgtgctgatcctgggctctgggtggggagccatctcgtttttaaagcacattgacaccaagaagtacaacgttagcatcatctctcccagaagctacttcttattcacccccctgctgcccagcgcccctgttgggaccgtggacgagaagtccatcattgagcccatcgtgaatttcgccctgaagaaaaaggggaacgttacctactacgaggccgaggccacctctatcaaccccgacaggaataccgtgaccatcaagagcctgtctgccgtgtcccagctgtaccagcccgagaaccacctaggcctgcatcaagccgagcccgccgagattaagtacgactatctgatcagtgccgtaggcgcggagcctaacacctttggtattcctggggtgaccgactacggtcacttcctgaaggagattcccaactctctggaaatccggcggacctttgccgccaacctggaaaaggctaacttactgcctaagggtgatcccgagcggagaagactgctgtccattgtcgtggttggcggagggcctactggtgtggaagctgctggtgagctacaggactacgtgcaccaggacctgcggaagttcctgcctgccttggccgaggaagtgcagattcacctggtggaagccctgcccatcgtgctgaacatgtttgagaagaagctgagcagctacgcgcaatcacatttagaaaacacctccatcaaggtgcatctgagaaccgccgtcgccaaggtggaagaaaagcagttgctggccaagaccaaacacgaggacggcaaaattaccgaagaaaccatcccctacggtaccctgatttgggccaccggtaacaaggccagacccgtaatcaccgaccttttcaagaaaatccccgagcaaaactcgtccaagcggggcttggccgtgaacgacttcctgcaggtcgagggcagcaacaacattttcgccatcggcgacaatgcctttagcgggttgcctcctaccgcccaagtggcccaccaggaagccgagtacttggccaagaactttgacaaaatggctcaaatcccaaatttccaaaagaacctgtcctcccggaaggataaaattgatctgctgttcgaggagaacaacttcaagcctttcaagtacaacgacttaggcgccttagcatacctgggatccgaaagagccattgcaaccatcagatccggcaagagaaccttctacaccggcggaggcttaatgaccttctacctgtggcggatcctgtacctgagcatgattctgagcgccagatcgagattaaaggtgtttttcgactggattaaattagcattcttcaaaagagactttttcaaaggactgtga

SEQ ID NO: 205 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtccgcttcgccagcaccagatccaccggcgtcgaaaacagcggagctggccccaccagctttaagaccatgaaggtcatcgacccccagcacagcgacaagcccaacgtgctgatcctgggctctggctggggagctatcagctttctgaagcacatcgacaccaagaagtacaacgtcagcatcatcagccccagaagctacttcctgttcacccctctgctgcccagcgcacctgtgggaaccgtggacgagaagtccatcatcgagcccatcgtgaacttcgccctgaagaaaaagggcaacgtcacctactatgaggccgaggccaccagcatcaaccccgaccggaacaccgtgaccatcaagagcctgagcgccgtgtcccagctataccagcccgagaaccacctgggcctgcaccaggccgagcccgccgaaattaagtacgactacctgatcagcgccgtgggcgccgagcccaacacctttggaatccccggcgtgaccgactacggccacttcctgaaagagatccccaacagcctggaaatccggcggactttcgccgccaacctggaaaaggctaacctgctgcctaagggcgaccccgaaagaagaaggctgctgagcatcgtggtcgtgggcggaggccccacaggcgtggaagctgctggcgagctgcaggattacgttcaccaggacctgcggaagttcctgcccgccctggccgaggaagtgcagattcacctggtggaagccctgcccatcgtgctgaatatgttcgagaaaaagctgagcagctacgcccagagccacctggaaaacacctccatcaaggtacacctgagaacggccgtggccaaggtggaagaaaagcagctgctggccaagaccaagcacgaggacggcaagattaccgaggaaaccatcccctacggtaccttgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaagtggcccaccaggaagccgagtacctggccaagaacttcgataagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggacattctacaccggcggaggcctgatgaccttctacctgtggagaatcctgtacctgagcatgatcctgagcgcccgcagcagactgaaggtgttcttcgactggatcaagctggccttcttcaagagggactttttcaaaggcctgtga

SEQ ID NO: 206 - DNA, 1542 bp, Artificial Sequence
  source: /note="Description of Artificial Sequence: Synthetic polynucleotide"
atgctgagcaagaacctgtacagcaaccggcggctgctcaccagcaccaacaccctcgtgcgcttcgccagcaccagatccacaggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccctagaagctatttcctgttcacccccctgctgcccagcgcccctgtgggaaccgtggacgagaagtccattatcgagcccatcgtgaacttcgccctgaagaaaaaggggaacgtcacctactacgaggccgaggccaccagcatcaaccccgaccggaacaccgtgaccatcaagagcctgagcgccgtgtcccagctataccagcccgagaaccacctgggcctgcaccaggccgagcccgccgagattaagtacgactatctgatcagcgccgtgggcgccgagcccaacacatttggaatccccggggtgaccgactacggccacttcctgaaagagatccccaacagcctggaaatccggcggaccttcgccgccaacctggaaaaggccaacctgttgcctaagggcgaccccgagcggagaaggctgctgagcatcgtggtcgtgggcggaggccccacaggcgtagaagctgctggcgaactgcaggactacgtgcaccaggacctgcggaagttcctgcccgcactggccgaggaagtgcagattcacctggtggaagccctgcccatcgtgctgaacatgttcgagaagaagctgagcagctacgcccagtcacacctggaaaacacctccatcaaggtgcacctgagaaccgccgtggccaaggtggaagagaagcagttgctggccaagaccaagcacgaagacggcaagattaccgaggaaaccatcccctacggcactctgatttgggccaccggcaacaaggccagaccggtgatcaccgacctgttcaagaagattcccgagcagaacagcagcaagagaggcctggccgtgaacgacttcctgcaggtcaaaggcagcaacaacatcttcgccatcggcgacaacgcctttgccggcctgcctcctacagcccaggtggcccaccaggaagccgagtacttggccaagaacttcgacaagatggcccagatacccaatttccagaagaacctgtcctcccggaaggataagattgacctgctgttcgaggaaaacaacttcaaacccttcaagtacaacgacctgggcgccctggcctacctgggcagcgaaagggccattgccaccatcagaagcggcaagcggaccttctacaccggcggaggcctgatgaccttctacctgtggcagatcctgtacctgagcatgatcctgagcgcccgctcgagattaaaggtgttcttcgactggatcaagctggcctttttcaagagggacttcttcaagggcctgtga

SEQ ID NO: 207 - DNA, 1542 bp, Artificial Sequence
  source: /note="Description of Artificial Sequence: Synthetic polynucleotide"
atgctgtcgaagaacctgtatagcaacaagcggctgctgacctcgaccaacaccctagtgcgcttcgccagcaccagatccaccggcgtcgaaaacagcggggctggccccaccagcttcaagaccatgaaggtcatcgaccctcagcacagcgacaagcccaacgtgctgatcctgggctctggctggggcgccatcagctttctgaagcacatcgacaccaagaagtacaacgtcagcatcatcagccccagaagctacttcctgttcacccctctgctgcccagcgcccctgttggaaccgtggacgagaagtccatcatcgagcccatcgtgaacttcgccctgaagaaaaaggggaacgtcacctactacgaggccgaggccaccagcatcaaccccgaccggaacaccgtgaccatcaaaagcctgagcgccgtgtcccagctgtaccagcctgagaaccacctgggcctgcaccaggccgaacccgccgaaattaagtacgactacctgatcagcgccgtgggcgccgagcctaacacctttggaatccccggcgtgaccgactacggccacttcctggaggagattcccaacagcctggaaatccggcggaccttcgccgccaacctggaaaaggccaacctgctgcctaagggcgaccccgagcggagaagactgctgagcatcgtggtcgtgggcggaggccccacaggcgtggaagccgctggcgagctgcaggactacgttcaccaggacctgcggaagttcctgcctgccctggccgaggaagtgcagattcacttggtggaagccctgcccatcgtgctgaacatgttcgagaaggagctgagctcatacgcccagagccacctggaaaacacctccatcaaggtgcatctgagaaccgctgtggccaaggttgaagagaagcagctgctggccaagaccaagcacgaggacggcaagattaccgaggaaaccattccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcatttgccggcctgcctcctacagcccaggtggcccaccaggaagccgagtatctggccaagaacttcgataagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacttgagcatgattctgagcgcccgcagcagactgaaggtgttcttcgactggatcaagctggccttcttcaagagggacttcttcaagggcctgtga

SEQ ID NO: 208 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgaccctcagcacagcgacaagcccaacgtgctgatcctgggctctggctggggcgccatcagctttctgaagcacatcgacaccaagaagtacaacgtcagcatcatcagccccagaagctatttcctgttcacccccttgctgcccagcgcccctgtgggaaccgtggacgagaagtccatcatcgagcccatcgtgaacttcgccctgaagaaaaagggcaacgtcacctactatgaggccgaggccaccagcatcaaccccgaccggaacaccgtgaccatcaagagcctgagcgccgtgtcccagctgtaccagcccgagaaccatctgggcatgcaccaggccgagcccgctgagattaagtacgactacctgatcagcgccgtaggcgccgagcccaacacctttggtatccccggcgtgaccgactacggccacttcctggaggagatccccaacagcctggaaatccggcggacctttgccgccaacctggaaaaggccaacctgctgcctaagggcgaccccgaacggagaaggctactgagcatcgtggtcgttggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaaaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggtaccctgatttgggccaccggcaacaaggcaagacccgtgatcaccgacctgttcaagaagatccccgagcaaaacagctccaagcggggcctggccgtgaacgacttcctgcaggtcaaaggcagcaacaacatcttcgccatcggcgacaacgcctttgccggcctgcctcctaccgcccaagtggcccaccaggaagccgagtacctggccaagaacttcgacaagatggcccagatccccaatttccagaagaacctgtcctcccggaaggataagatcgacctgttgttcgaggaaaacaacttcaagcccttcaagtacaacgacctgggcgccctggcctacctgggatccgaaagagccattgcaaccatcagatccggcaagcggaccttctacaccggcggaggcctgatgaccttctacctgtggcggatcctgtacctgagcatgatcctgagcgcccgctcgagattaaaggtgtttttcgactggatcaaactggccttcttcaagagggacttcttcaagggcttatga

SEQ ID NO: 209 - DNA, 1542 bp, Artificial Sequence
  source: /note="Description of Artificial Sequence: Synthetic polynucleotide"
atgctgagcaagaacttgtacagcaacaagcggttgctgaccagcaccaacaccctcgtgcgcttcgccagcaccagatccaccggcgtcgaaaacagcggggctggccccaccagcttcaagaccatgaaagtcatcgacccccagcacagcgacaagcccaacgtgctgatcctgggttctggctggggagccatcagctttctgaagcacatcgacaccaagaagtacaacgtcagcatcatcagccccagaagctacttcctgttcacccccctgatgcccagcgcccctgtggggaccgtggacgagaagtccatcattgagcccatcgtgaacttcgccctgaagaaaaagggcaacgtcacctactatgaggccgaagccaccagcatcaaccccgaccggaacaccgtgaccatcaagagcctgagcgccgtgtcccagctgtaccagcccgagaaccacctaggcatgcaccaggccgagcccgccgagattaagtacgactacctgatcagcgctgtgggcgccgaacccaacacctttggtatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtggtgggcggaggccccacaggcgtggaagctgctggcgagctgcaggactacgtgcaccaggacctgcggaagttcctgcctgcactggccgaggaagtgcagattcacctggtggaagccctgcccatcgttctgaacatgttcgagaagaagctgagcagctacgcccagagccacctggaaaacacctccatcaaggtgcacctgagaaccgctgtggccaaggtggaagagaagcagctgctggccaagaccaagcacgaagacggcaaaattaccgaggaaaccatcccctacggcaccctgatttgggccaccggcaacaaggccagacccgtgatcaccgacctgttcaagaagatccccgagcaaaacagcagcaagcggggcctggccgtgaacgacttcctgcaggtcaaaggcagcaacaacatcttcgccatcggcgacaacgcctttgccggcctgcctcctacagcccaggtggcgcaccaggaagccgagtacctggccaagaacttcgacaagatggcccagatccccaatttccagaagaacctgtcctcccggaaggataagattgacctcctgttcgaggaaaacaacttcaagcccttcaagtacaacgacttaggcgccctggcctacctgggcagcgaaagggccattgccaccatcagaagcggcaagcggaccttctacaccggcggaggcctgatgaccttctacctgtggagaatcctgtacctgagcatgatcctgagcgccagaagcagactgaaggtgttcttcgactggatcaagctggccttcttcaagagggacttcttcaaaggcctgtga

SEQ ID NO: 210 - DNA, 1542 bp, Artificial Sequence
  source: /note="Description of Artificial Sequence: Synthetic polynucleotide"
atgctgagcaagaatctgtacagcaacaagcggctgctgacctcgaccaacaccctcgtgcgcttcgccagcaccagatccaccggcgtcgaaaacagcggggctggtcccaccagcttcaagaccatgaaggtcatcgaccctcagcacagcgacaagcccaacgtgctgatcctgggctctggctggggcgccatttcgtttctgaagcacatcgacaccaagaagtacaacgtcagcatcatcagccccagaagctacttcctgttcacccccctgctgcccagcgcacctgtgggaaccgtggacgagaagtcaatcatcgagcccatcgtgaacttcgccctgaagaaaaagggcaacgtcacctactacgaggccgaggccaccagcatcaaccccgaccggaataccgtgaccatcaaaaacctgagcgccgtgtcccagctgtaccagcccgagaaccacctgggcctgcaccaagccgagcccgccgagattaagtacgactacctgatcagcgccgtgggcgccgagcccaacacctttggaatccccggcgtgaccgactacggccatttcctgaaagagatccccaacagcctggaaatacggagaaccttcgccgccaacctggaagaggccaacctgctgcctaagggcgaccccgagcggagaaggctgctgagcattgtggtcgtgggcggtggccccactggcgtggaagctgctggcgagctgcaggattacgtgcaccaggacctgcggaagttcctgcccgcactggccgaggaagtgcagattcacctggtggaagccctgcccatcgtgctgaacatgttcgagaaaaagctgagcagctacgcccagagccacctggaaaacacctccatcaaggtgcacctgagaaccgccgtggccaaggtggaagagaagcagctgttggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacattttcgccattggcgacaacgcctttgccggcctgcctcctacagcccaggtggcccaccaggaagccgagtacctggccaagaacttcgacaagatggctcaaatccccaatttccagaagaacctgtcttcccggaaggataagatcgacctgctgttcgaggaaaacaacttcaagcccttcaagtacaacgacctgggcgccctggcctacctgggcagcgaaagagccattgccaccatcagaagcggcaagagaacattctacaccggcggaggcctgatgaccttctacctgtggcggatcctgtacctgagcatgatcctgagcgccagaagcagactgaaggtgttcttcgactggatcaagctggccttcttcaagagggacttcttcaagggcctgtga

SEQ ID NO: 211 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgcctccaccagatccaccggcgtcgaaaacagcggggctggccccaccagcttcaagaccatgaaggtcatcgacccccagcacagcgacaagccaaacgtgctgatcctgggctctggctggggcgccatcagctttctgaagcacatcgacaccaagaagtacaacgttagcatcatcagccccagaagctacttcctgttcacccccctgctgcccagcgcccctgtggggaccgtggacgagaagtccatcatcgagcccatcgtgaacttcgctctgaagaaaaagggcaacgttacctactacgaggccgaggccaccagcatcaaccccgaccggaacaccgtgaccatcaagagcctgagcgccgtgtcccagctgtaccagcccgagaaccacctaggcctgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggagggcccacaggcgtggaagctgctggcgagctgcaggactacgtgcaccaggacctgcggaagttcctgcctgccctggccgaggaagtgcagattcacctggtggaagctctgcccatcgtgctgaacatgtttgagaagaagcttagcagctacgcccagtcacacctggaaaacacttccatcaaagtgcacctgagaaccgccgtggccaaggtggaagagaagcagctgctggccaagaccaagcacgaggacggtaagattaccgaggaaaccatcccatacggcaccctgatttgggccaccggcaacaaggccagacccgtgatcaccgacctgttcaagaaaatccccgagcagaacagcagcaagcggggcctggccgtgaacgacttcttgcaggtcaaaggcagcaacaacatcttcgccatcggcgacaacgcctttgctggcctgcctcctacagcccaggtggcccaccaggaggccgagtacatcgccaagaacttcgacaagatggcccagatccccaatttccagaagaacctgtcctcccggaaggataagattgacctgctgttcgaggaaaacaacttcaagcccttcaagtacaacgacctgggcgccctggcatacctgggcagcgaaagagccattgccaccatcagaagcggcaagagaaccttctacaccggcggaggcttaatgaccttctacctgtggcggatcctgtacttgagcatgattctgagcgcacgcagcagattaaaggtgttcttcgactggatcaagctggccttcttcaagagggacttcttcaagggcctgtga

SEQ ID NO: 212 - DNA, 1542 bp, Artificial Sequence
  source: /note="Description of Artificial Sequence: Synthetic polynucleotide"
atgctgagcaagaacctgtatagcaaccggcggctgctgaccagcaccaacaccctcgtgagattcgccagcaccagatccaccggcgtcgaaaacagcggggctggccccaccagcttcaagaccatgaaggtcatcgacccccagcacagcgacaagcccaacgtgctgatcctgggctctgggtggggcgccatcagctttctgaagcacatcgacaccaagaagtacaacgtcagcatcatctctcccagaaagtatttcctgttcacccccctgctgcccagcgcccctgtgggaaccgtggacgagaagtccatcatcgagcccatcgtgaacttcgccctgaagaaaaagggcaacgtcacctactacgaggccgaggccacctctatcaaccccgaccggaacaccgtgaccatcaagagcctgagcgccgtgagccagctgtaccagcccgagaaccacctgggcctgcaccaggccgagcccgccgagattaagtacgactacctgatcagcgccgtgggtgccgagcccaacacctttggaatccccggcgtgaccgactacggccacttcctgaaagagatccccaacagcctggaaatccggcggaccttcgccgccaacctggaaaaggccaacctgctgccaaagggcgaccccgagcggagaaggctgctgagcatcgtggtcgtgggcggaggccccacaggcgtggaagctgctggcgagctacaggactatgttcaccaggacctgcggaagttcctgcccgccctggccgaggaagtgcagattcacctggtggaagccctgcccatcgtgctgaatatgttcgagaagaagctgagcagctacgcccagagccacctggaaaacacctccatcaaggtgcacctgagaaccgccgtggccaaggtggaagagaagcagttgctggccaagaccaagcacgaggacggcaagattaccgaggaaaccatcccctacggcaccttgatttgggccaccggcaacaaggccagacccgtgatcaccgacctgttcaagaagatccccgagcagaacagcagcaagagaggcctggccgtgaacgacttcctgcaggtcaaaggcagcaacaacatcttcgccatcggcgacaacgcctttgccggcctgcctcctacagcccaggtggcccaccaagaagccgagtacctggccaagaactttgataagatggcccagatccccaatttccagaagaatctgtcctcccggaaggataagatcgacctgctgttcgaggagaacaactttaaacccttcaagtacaacgacctgggcgccctggcctacctgggcagcgaaagagccattgcaaccatcagaagcggtaagcggacattctacaccggcggaggcctgatgaccttctacctgtggcggatcttgtacctgagcatgatcctgtctgcccgcagcagactgaaggtcttcttcgactggatcaagctggccttcttcaagagggacttcttcaagggcctgtga

SEQ ID NO: 213 - DNA, 1542 bp, Artificial Sequence
  source: /note="Description of Artificial Sequence: Synthetic polynucleotide"
atgctgagcaagaacttgtacagcaacaagcggctgctgaccagcaccaatacgctagtgagattcgccagcaccagatccaccggcgtcgaaaacagcggggctggccccaccagcttcaagaccatgaaggtcatcgacccccagcacagcgacaagcccaacgtgctgatcctgggctctggctggggcgccattagctttctgaagcacatcgacaccaagaagtacaacgtcagcatcatcagccccagaagctatttcctgcacacccccctgctgcccagcgcccctgtggggaccgtggacgagaagtccatcatcgagcccatcgtgaatttcgccctcaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgaacccgccgagattaagtacgactacctgatcagtgccgtgggcgccgagcccaacacctttggaatccctggggtcaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactatgtgcaccaggacctgcggaagttcctgcccgccctggccgaggaagtgcaaattcacctggtggaagccctgcccatcgtgctgaatatgttcgagaaaaagctgagctcatacgcccagagccacctggaaaacacctccatcaaggtgcacctgagaaccgctgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggcagtgaacgacttcctgcaggtcaaaggcagcaacaacatcttcgccatcggcgacaacgcctttgccggcttgcctcctacagcccaggtggcccaccaagaagccgaatacctggccaagaacttcgacaagatggcccagatccccaatttccagaagaacctgtcctcccggaaggataagatcgacctgctgttcgaggaaaacaacttcaagcccttcaagtacaacgacctgggtgccctggcctacctgggcagcgaaagagccattgccaccataagaagcggcaagcggaccttctacaccggcggaggcctgatgaccttctacctgtggcagatcctgtacctgagcatgatcctgagcgccagaagcagactgaaggtgttcttcgactggatcaagctggcattcttcaagagggacttcttcaagggcctgtga

SEQ ID NO: 214 - DNA, 1542 bp, Artificial Sequence
  source: /note="Description of Artificial Sequence: Synthetic polynucleotide"
atgctgtcgaagaacttgtacagcaaccggcggctgctgaccagcaccaacaccctcgtgcgcttcgccagcaccagatccaccggcgtcgaaaacagcggagctggccccacctcttttaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcctgagaaccacctgggcctgcatcaggccgagcccgccgagattaagtacgactacctgatcagtgccgtaggcgccgagcccaacacatttggaatccccggcgtgaccgactacggccacttcctgaaagagatccccaacagcctggaaatccggcggacctttgccgccaacctggaaaaggctaacctgttgcctaagggcgaccccgaacggagaaggctactgtccatcgtggtcgttggcggaggccccacaggcgtggaagctgctggcgagctgcaggactacgtgcaccaggacctgagaaagttcctgcccgccctggccgaggaagtgcagattcacctggtggaagccctgcccatcgtgctgaacatgttcgagaagaagctgagcagctacgcccagagccatctggaaaacacctccatcaaggtgcacctgagaaccgctgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgactttctgcaggtcaaaggcagcaacaacattttcgccatcggcgacaacgcctttgccggcctgcctcctacagcccaggtggcccaccaggaagccgagtacctggccaagaacttcgacaagatggcccagatacccaatttccagaagaacctgtcctcacggaaggataagatcgacctgctgttcgaggaaaacaacttcaagcccttcaagtacaacgacctgggcgccctggcctacctgggcagcgaaagagccattgccaccatcagaagcggcaagcggaccttttacaccggtggtggcctgatgaccttctacctgtggcggattctgtacctgagcatgatcctgagcgcccgcagcagactgaaggtgttcttcgactggatcaaactggccttcttcaagagggacttcttcaagggcctgtga

SEQ ID NO: 215 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagctttaagaccatgaaggtcatcgacccccagcacagcgacaagcccaacgtgctgatcctgggctctggctggggcgccatcagctttctgaagcacatcgacaccaagaagtacaacgtcagcatcatcagccctagaaagtacttcctgttcacccccctgctgcccagcgccccagtgggaaccgtggacgagaagtccatcatcgagcccatcgtgaactttgccctgaagaaaaagggcaacgtcacctactacgaggccgaggccaccagcatcaaccccgaccggaacaccgtgaccatcaaaagcctgagcgccgtttcccagctgtaccagcccgagaaccacctgggcctgcaccaggccgagcccgccgagattaagtacgactacctgatcagcgccgtgggcgccgagcctaacacctttggaatccccggcgtgactgactacggccacttcctgaaagagattcccaacagcctggaaatccggcggaccttcgccgccaacctggaaaaggccaacctgctgccaaagggcgatcccgagcggagaaggctgctgagcatcgtggtcgtgggcggaggccccacaggcgtggaagctgctggcgagctgcaggactacgtgcaccaggacctgcggaagttcctgcccgcactggccgaggaagtgcagattcacctggtggaagccctgcccatcgtgctgaacatgttcgagaaggagctgagctcatacgcccagagccacctggaaaacacctcgatcaaggtgcacctgagaaccgctgtggccaaagtggaagagaagcagctgctggcaaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcttggccgtgaacgacttcctgcaggtgaaaggcagcaacaacatcttcgccatcggcgacaacgcctttgccggcctgcctcctacagcccaggtggcgcaccaggaagccgaatacctggccaagaactttgacaagatggcccagatccccaatttccaaaagaacctgtcctcccggaaggataagatcgacctgctgttcgaggaaaacaacttcaagcccttcaagtacaacgacctgggcgccctggcatacctgggcagcgaaagagccattgccaccatcagaagcggcaagcggaccttttacaccggcggaggcctgatgaccttctacctgtggcggatcttgtacctgagcatgatcctgagcgcacgcagcagactgaaggtgttcttcgactggattaagctggccttcttcaagagggacttctttaagggcctgtga

SEQ ID NO: 216 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggtcccaccagcttcaagaccatgaaggtcatcgacccccagcacagcgacaaacccaacgtgctgatcctgggctctggctggggcgccattagctttctgaagcacatcgacaccaagaagtacaacgtcagcatcatcagccccagaagctacttcctgcacacccctctgctgcccagcgccccagtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgaaaaccacctgggcctgcaccaggccgagcccgccgagattaagtacgactacctgatcagcgccgtgggcgccgagcccaacacctttggaatccccggcgtgaccgactacggccacttcctggaggagatccccaacagcctggaaatccggcggacctttgccgccaacctagaaaaggccaacctgctgcctaagggcgaccccgagcggagaaggctgctgagcatcgtggtcgtgggcggaggccccacaggcgtggaagccgctggtgagctgcaggactacgtgcaccaggacctgcggaagtttctgcccgccctggccgaggaagtccagattcacctggtggaagccctgcccatcgtgctgaatatgttcgagaagaagctgagcagctacgcgcagagccacctggaaaacacctccatcaaggtgcatctgagaaccgccgtggccaaggtggaagagaagcaactgctggccaagaccaagcacgaggacggcaagattaccgaggaaaccatcccctacggcaccctgatttgggccacgggcaacaaggccagacccgtgatcaccgacctgttcaagaagatccccgagcagaacagcagcaagcggggcttggccgtgaacgacttcctgcaggtgaaaggcagcaacaacattttcgccatcggcgacaacgcctttgccggcctgcctcctaccgcccaggtggcccaccaggaagccgagtacctggccaagaacttcgacaagatggcccagatccccaatttccagaagaacctgtcctcccggaaggataagattgacctgctgttcgaggaaaacaacttcaagcccttcaagtacaacgacctgggtgccctggcctacctgggcagcgaaagagccattgcaaccatcagaagcggcaagcggaccttctacaccggcggaggcctgatgaccttctacctgtggcggatcctgtacctgtccatgatcctgagcgcccgcagcagactgaaggtgttcttcgactggatcaagctggcatttttcaaaagagacttcttcaagggcctgtga

SEQ ID NO: 217 - DNA, 1542 bp, Artificial Sequence
  source: /note="Description of Artificial Sequence: Synthetic polynucleotide"
atgctgagcaagaacctgtacagcaacaagcggctgctgaccagcaccaacacgctcgtgcgcttcgcctccaccagatccaccggcgtcgaaaacagcggagctggccccaccagcttcaagaccatgaaggtcatcgacccccagcacagcgacaagcccaacgtgctgatcctgggctcgggctggggcgccatcagctttctgaagcacatcgacaccaagaagtacaacgtcagcatcatcagccccagaaagtatttcctgttcacccccctgctgcccagcgcccctgtgggaaccgtggacgagaagtccatcatcgagcccatcgtgaatttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgaacccgccgagattaagtacgactacctgatcagcgccgtgggcgccgagcccaacacatttggaatccctggcgtgaccgactacggccacttcctgaaagagatccccaacagcctggaaatccggagaaccttcgccgccaacctggaaaaggccaacctgctgcctaagggcgaccccgaacggagaaggctgctgagcatcgtggtcgtgggcggaggccccacaggcgtggaagctgctggcgagctgcaggactacgtgcaccaggacctgcggaagttcttccctgccctggccgaagaagtgcagattcacctggtcgaagccctgcccatcgtgctgaacatgtttgagaaaaagctgagcagctacgcccagagccatctggaaaacacctccatcaaggtacacctgagaaccgccgtggccaaggttgaagagaagcagctgctggccaagaccaagcacgaggacggcaagattaccgaagaaaccatcccctacggtaccctgatttgggccaccggtaacaaggccagacccgtgatcaccgacctgttcaagaagatccctgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtatctggccaagaacttcgacaagatggcccagatccccaatttccaaaagaacctgtcctcccggaaggataagatcgacctgctgttcgaggaaaacaacttcaagcctttcaagtacaacgatctgggcgccctggcctacctgggcagcgaaagagccattgccaccatcagaagcggcaagcggaccttctacaccggcggaggcctgatgaccttctacctgtggcggatcctgtacctgagcatgatcctaagcgcccgcagcagactgaaggtgttcttcgactggattaagctggccttcttcaagagggacttcttcaagggcctgtga

SEQ ID NO: 218 - DNA, 1542 bp, Artificial Sequence
  source: /note="Description of Artificial Sequence: Synthetic polynucleotide"
atgctgagcaagaacctgtacagcaacaagcggctgctgacctcgacgaacaccatggtgcgcttcgccagcaccagatccaccggcgtcgaaaacagcggagctggccctaccagcttcaagaccatgaaggtcatcgacccccagcacagcgacaagcccaacgtgctgatactgggctctggctggggcgccatcagctttctgaagcacatcgacaccaagaagtacaacgtcagcatcatcagccccagaagctatttcctgttcacccccctgctgcccagcgcccctgtgggaacagtggacgagaagtccatcatcgagcccatcgtgaactttgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtaggcgccgagcccaacacctttggaatccctggggtcaccgactacggccacttcctgaaagagatccccaacagcctggaaatccggcggaccttcgccgccaacctggaaaaggccaacctgctgcctaagggcgaccccgaacggagaagactgctgagcatcgtggtcgtgggcggaggccccacaggtgtggaagctgctggcgagctgcaggactacgtgcaccaggacctgcggaagttcctgcccgccctggccgaggaagtgcagattcacctggtggaagccctgcccatcgtgctgaatatgttcgagaagaagctgagcagctacgcccagagccacctggaaaacacctccatcaaggtgcacctgagaaccgccgtggccaaggtggaagagaagcagctgctggccaagaccaagcacgaagacggcaagattaccgaggaaactatcccatacggcaccctgatttgggccaccggcaacaaggccagacccgtgatcaccgacctgttcaagaagatccccgagcagaacagcagcaagagaggcctggccgtgaacgacttcctgcaggtgaaaggcagcaacaacatcttcgccatcggcgacaacgcctttgccgggctgcctcctacagcccaggtggcccaccaggaagccgagtacctggccaagaacttcgacaagatggcccaaatccccaatttccagaagaacctgtcctccagaaaggataagatcgacctgctgttcgaggagaacaacttcaagcccttcaagtacaacgacctgggcgccctggcctacctgggcagcgaaagagccattgccaccatcagaagcggtaagcggaccttctacaccggcggaggcctgatgaccttctacctgtggcggatcctgtacatgagcatgatcctgagcgcccgcagcagattaaaggtgttcttcgactggatcaagctggcctttttcaagagggacttcttcaagggcctgtag

SEQ ID NO: 219 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgcctccaccagatccaccggcgtcgaaaacagcggggctggccccaccagcttcaagaccatgaaggtcatcgacccccagcacagcgacaagcccaacgtgctgatactgggctctggctggggcgccatcagctttctgaagcacatcgacaccaagaagtacaacgtcagcatcatcagccccagaagctatttcctgttcacccccctgctgcccagcgcccctgttggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgtctgccgtgtcccagctgtaccagcccgagaaccacctgggcatgcaccaggccgagcccgccgagattaagtacgactacctgatcagcgccgtgggcgcggagcccaacacctttggaattcctggcgtgaccgactacggccacttcctgaaagagatccccaacagcctggaaatccggcggaccttcgccgccaatctggaaaaggctaacctgctgccaaagggcgaccccgagcggagaaggctgctgagcatcgtggtcgtgggcggaggccccacaggcgtggaagctgctggcgagctgcaggactacgtgcaccaggacctgcggaagttcctgcctgccctggccgaggaagtgcagattcacctggtggaagccctgcccatcgtgctgaacatgttcgagaagaagctgagcagctacgcccagagccacctggaaaacacctccatcaaggtgcacctgagaaccgccgtcgccaaggtggaagagaagcagctgctggccaagaccaagcacgaggacggcaagattaccgaggaaaccatcccctacggcaccctgatttgggccaccggcaacaaggccagacccgtgatcaccgacctgttcaagaaaatccccgagcagaacagcagcaagcggggcctggccgtgaacgacttcctgcaggtcaaaggcagcaacaacatcttcgccatcggtgacaacgcctttagcggcttgccacctacagcccaggtggcccaccaggaagccgaatacctggccaagaacttcgacaagatggcccagatacccaatttccaaaagaacctgtcctcccggaaggataagatcgacctgctgttcgaggaaaacaacttcaagcccttcaaatacaacgacctgggcgccctggcctacctgggcagcgaaagggccattgccaccatcagaagcggcaagagaaccttctacaccggcggaggcctgatgaccttctacctgtggcggattttgtacctgtccatgatcctgagcgcccgctcgagattaaaggtgttcttcgactggatcaagctggccttcttcaagagagacttcttcaagggcctgtga

SEQ ID NO: 220 - DNA, 1542 bp, Artificial Sequence
  source: /note="Description of Artificial Sequence: Synthetic polynucleotide"
atgctgagcaagaacctgtatagcaacaagaggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatactgggctctggctggggcgccatcagctttctgaagcacatcgacaccaagaagtacaacgtcagcatcatcagccccagaagctacttcttattcacccccctgctgcccagcgcacctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctaggcctgcaccaagccgaacccgccgaaattaagtacgactatctgatcagcgccgtgggcgccgagcctaacacctttggaatccccggcgtgaccgactacggccacttcttcaaagagatccccaacagcctggaaatccggagaaccttcgccgccaacctggaaaaggccaacctgctgcctaagggcgaccccgagcggagaaggctgctgagcatcgtggtcgtgggcggtggccccacaggcgtggaagctgctggcgagctgcaggactacgtgcaccaggacctgcggaagttcctgcctgccctggccgaggaagtgcagattcacctggtggaagctctgcccatcgtgctgaacatgttcgagaagaagctgagcagctacgcccagagccatctggaaaacacctccatcaaggtgcacctgagaaccgccgtggccaaggtggaagaaaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcatttgccggcctgccacctacagcccaggtggcccaccaggaggccgagtacctggccaagaacttcgataagatggctcagatccccaatttccagaagaatctgtcctcccggaaggataagatcgatctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgtccatgatcctgagcgccagatcgagactgaaggtgttcttcgactggatcaaaatggcctttttcaagagggacttcttcaagggcctgtga

SEQ ID NO: 221 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaagtcatcgacccccagcacagcgacaagcccaacgtgctgatcctgggttcgggctggggcgccatctcgtttctgaagcacatcgacaccaagaagtacaacgtcagcatcatcagccccagaagctacttcctgttcacccccctgctgcccagcgcccctgttgggaccgtggacgagaagtccatcattgagcccatcgtgaacttcgccctgaagaaaaagggcaacgtcacctactatgaggccgaggccaccagcatcaaccccgaccggaacaccgtgaccatcaaaaacctgagcgccgtgtcccagctgtaccaacccgagaaccacctgggcctgcaccaggccgagcccgccgagattaagtacgactacctgatcagcgccgtgggcgccgagcccaacacctttggaatccccggcgtgaccgactacggtcacttcctgaaagagatccccaacagcctggaaatccggcggaccttcgccgccaacctggaaaaggccaacctgctgcctaagggtgaccccgagcggagaaggctgctgagcatcgtggtcgtgggcggaggccccacaggcgtggaagctgctggtgagctgcaggactacgtgcaccaggacctgcggaagttcctgcccgcactggccgaggaagtgcaaattcacctggtggaagccctgcccatcgttctgaatatgttcgagaagaagctgagcagctacgcccagagccacctggaaaacacctccatcaaggtgcacctgagaaccgccgtggccaaggttgaagagaagcagctgctggccaagaccaaacacgaggacggcaaaattaccgaggaaaccatcccctacggcaccctgatttgggccaccggcaacaaggccagacccgtgatcaccgacctgttcaagaagatccctgagcagaacagcagcaagcggggcctggccgtgaacgacttcctgcaggtcaaaggcagcaacaacatcttcgccatcggcgacaacgcctttgccggcctgcctccaacagcccaggtggcccaccaggaagccgagtacctggccaagaacttcgacaagatggcccagatccccaatttccagaagaacctgtcttccagaaaggataagattgacctgctgttcgaggaaaacaacttcaagcccttcaagtacaacgacctgggcgccctggcctacctgggcagcgaaagggccattgcaaccatcagaagcggcaagcggaccttctacaccggcggaggcctgatgaccttctacctgtggcggatcctgtacctgagcatgattctgagcgcccgcagcagactgaaggtgtttttcgactggatcaagatggccttcttcaagagggacttcttcaagggcctgtga

SEQ ID NO: 222 - DNA, 1542 bp, Artificial Sequence
  source: /note="Description of Artificial Sequence: Synthetic polynucleotide"
atgctgagcaagaacctgtacagcaaccggcggctgctgaccagcacgaacaccctcgtgcgcttcgcctccaccagatccacaggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccttgctgccctctgcccctgtgggaaccgtggacgagaagtccattatcgagcccatcgtgaacttcgccctgaagaaaaagggcaacgtcacctactatgaggccgaggccaccagcatcaaccccgaccggaacaccgtgaccatcaaaaacctgagcgccgtgtcccagctgtaccagcccgagaaccacctaggcctgcaccaagccgaacccgccgagattaagtacgactacctgatcagcgccgtgggcgccgagcccaacacctttggaatccccggcgtgaccgactacggccacttcctgaaagagatccccaacagcctggaaatcagacggactttcgccgccaacctggaaaaggccaacctgctgcctaagggcgaccccgagcggagaagactgctgagcattgtcgtcgtgggcggagggcccacaggcgtggaagctgctggcgagctgcaggactacgttcaccaggacctgcggaagttcctgcccgcactggccgaggaagtgcagattcacctggtggaagccctgcccatcgtgctgaacatgttcgagaagaagctgagcagctacgcccagagccacttagaaaacacctccatcaaggtgcatctgagaaccgccgtggccaaggtggaagagaagcagctgctggccaagaccaagcacgaggacggcaagattaccgaggaaaccatcccctacggtaccttgatttgggccaccggcaacaaggccagacccgtgatcaccgacctgttcaagaagatccccgagcaaaactcgagcaagcggggcctggccgtgaacgacttcctgcaggtcaaaggcagcaacaacatcttcgccatcggcgacaacgcatttgccggcctgcctcctacagcccaggtggcccaccaggaagccgagtacctggccaagaacttcgacaagatggcccagatccccaatttccagaagaacctgtcttcccggaaggataagatcgacctgctgttcgaggaaaacaacttcaagcccttcaagtacaacgacctgggcgccctggcctacctgggcagcgaaagagccattgccaccatcagatccggcaagcggaccttctacaccggcggaggcctgatgaccttctacctgtggcggatcctgtacctgagcatgatcctgagcgcccgcagcagactgaaggtgttcttcgactggatcaagctggcattcttcaagagggacttcttcaagggcctgtga

SEQ ID NO: 223 - DNA, 1542 bp, Artificial Sequence
  source: /note="Description of Artificial Sequence: Synthetic polynucleotide"
atgctgagcaagaacctgtacagcaacaagaggctgctgaccagcaccaacaccatggtgcgcttcgccagcaccagatccaccggcgtcgaaaactccggggctggccccacaagcttcaagaccatgaaggtcatcgacccccagcacagcgacaagccaaacgtgctgatcctgggctctggctggggcgccatcagctttctgaagcacatcgacaccaagaagtacaacgtcagcatcatcagccccagaagctacttcctgttcacccccctgatgcccagcgcccctgtgggaaccgtggacgagaagtccatcattgagcccatcgtgaatttcgccctgaagaaaaaggggaacgtcacctactacgaggccgaggccaccagcatcaaccccgaccggaacaccgtgaccatcaaaagcctgagcgccgtgtcccagctgtaccagcccgagaaccacctgggcctgcaccaagccgagcccgctgagattaagtacgactacctgatcagcgccgtgggcgccgagcccaacacctttggaatccccggcgtgaccgactacggccacttcctgaaagagatccccaacagcctggaaatccggcggacctttgccgccaatctggagaaggccaacctgctgcctaagggcgatcccgagcggagaaggctgctgagcatcgtggtcgtgggcggaggccccacaggtgtggaagctgctggcgaactgcaggactacgtgcaccaggacctgcggaagttcctgcccgccctggccgaggaagtgcagattcacctggtggaagccctgcccatcgtgctgaacatgtttgagaagaagctgagcagctacgcccagagccacctggaaaacacctccatcaaggtgcacctgagaaccgccgtggccaaggtggaagagaagcagctgctggccaagaccaagcacgaggacggtaagattaccgaggaaaccatcccctacggcaccctgatttgggccaccggcaacaaggccagacccgtgatcaccgacctgttcaagaagatccccgagcagaactcgagcaagcggggcctggccgtgaacgacttcctgcaggtgaaaggcagcaacaacattttcgccattggcgacaacgcctttgccggcctgcctcctacagcccaggtggcccaccaggaagccgagtacctggccaagaatttcgacaagatggcccaaatccccaatttccagaagaacctgtcctcccggaaggataagatcgatctgctgttcgaggaaaacaacttcaagcccttcaagtacaacgacctgggcgccctggcctacctgggcagcgaaagagccattgccaccatcagatccggcaagcggaccttctacaccggcggaggcttaatgaccttctacttatggcggatcctgtacctgagcatgatcctgagcgcccgcagcagactgaaggtgttcttcgactggatcaagctggccttcttcaagagagacttcttcaagggcctgtga

SEQ ID NO: 224 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccattagctttctgaagcacatcgacaccaagaagtacaacgtcagcatcatcagccccagaagctacttcctgttcacccccctgctgcccagcgcccctgtgggaaccgtagacgagaagtccatcatcgagcccatcgtgaacttcgccctgaagaaaaagggcaacgtcacctactacgaggccgaggccacctctatcaaccccgacaggaacaccgtgaccatcaagagcctgtctgccgtgtcccagctgtaccagcccgagaaccatctgggcctgcaccaagccgagcccgccgagattaagtacgactacctgatcagcgccgtgggcgccgagcccaacacctttggaatccccggggtcaccgactacggccacttcttcaaggagatccccaacagcctggaaatccggcggaccttcgccgccaacctagaaaaggccaacctgctgcctaagggcgaccccgagcggagaaggctgctgagcatcgtcgtcgttggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagtcacatctggaaaacacctcgatcaaggtgcatctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcaaaacagcagcaagcggggcttggccgtgaacgacttcttgcaggtcaaaggcagcaacaacatcttcgccatcggcgacaatgcctttgccggcctgcctcctacagcccaggtggcgcaccaggaagccgagtacctggccaagaacttcgacaaaatggcccagatccccaatttccagaagaacctgtcctcccggaaggataagatcgacctgctgttcgaggagaacaacttcaagcccttcaagtacaacgacctgggcgccctggcctacctgggaagcgaaagagccattgccaccatcagaagcggcaagcggaccttctacaccggcggaggcctgatgaccttctacctgtggcggatcttgtacatgagcatgatcctgagcgcccgcagcagactgaaggtcttcttcgactggatcaagttagccttcttcaagagggacttcttcaagggcttatga

SEQ ID NO: 225 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcgaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 226 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcgagggcctgtga

SEQ ID NO: 227 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagatggccttcttcaagagggacttcttcaagggcctgtga

SEQ ID NO: 228 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 229 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 230 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacctgagcatgatcctgagcgcccgcagcagactgaaggtgttcttcgactggatcaagctggccttcttcaagagggacttcttcaagggcctgtga

SEQ ID NO: 231 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 232 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 233 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 234 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 235 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 236 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttagcggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 237 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacctgagcatgatcctgagcgcccgcagcagactgaaggtgttcttcgactggatcaagctggccttcttcaagagggacttcttcaagggcctgtga

SEQ ID NO: 238 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 239 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 240 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 241 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagatggccttcttcaagagggacttcttcaagggcctgtga

SEQ ID NO: 242 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcgagggcctgtga

SEQ ID NO: 243 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacctgagcatgatcctgagcgcccgcagcagactgaaggtgttcttcgactggatcaagctggccttcttcaagagggacttcttcgagggcctgtga

SEQ ID NO: 244 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 245 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaattagcatttttcaaaagagacttttttaaaggattatag

SEQ ID NO: 246 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 247 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttgagggattatag

SEQ ID NO: 248 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacatgtccatgattctatctgcaagatcgagattaaaggtctttttcgactggattaaattagcatttttcaaaagagacttttttaaaggattatag

SEQ ID NO: 249 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 250 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttacacacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 251 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 252 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaattagcatttttcaaaagagacttttttaaaggattatag

SEQ ID NO: 253 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaattagcatttttcaaaagagacttttttaaaggattatag

SEQ ID NO: 254 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaaatggcatttttcaaaagagacttttttaaaggattatag

SEQ ID NO: 255 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 256 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttgagggattatag

SEQ ID NO: 257 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 258 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttagcgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 259 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 260 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 261 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaattagcatttttcaaaagagacttttttgagggattatag

SEQ ID NO: 262 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaaatggcatttttcaaaagagacttttttaaaggattatag

SEQ ID NO: 263 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 264 - DNA, 1542 bp, Artificial Sequence
  source: /note="Description of Artificial Sequence: Synthetic polynucleotide"
atgctatcgaagaacttgtacagtaacaagaggttgctcacctcgaccaatacgctagtgagattcgcttccaccagatccacaggggtggaaaactccggggcaggccctacatctttcaagaccatgaaagtcattgaccctcagcacagcgacaaaccaaacgtgctgatactgggttcggggtggggagctatctcgtttttaaagcacattgacaccaagaagtacaacgtttccatcatcagccccagaaagtatttcttatttacgcctttgttaccttctgcaccagttgggacagtggacgaaaagtccattatcgagcccatcgtgaattttgctctcaagaaaaagggcaacgttacctactatgaggcagaagccaccagcatcaatcccgacaggaacaccgtgaccataaagagcctgagcgccgtgagccagctgtaccagcctgaaaaccatctagggctgcaccaagcagagcccgctgaaattaagtacgattatttaatcagtgctgtaggcgcggaacccaacacatttggaattcctggggtgactgactacggtcatttcctgaaggaaattcccaactctctggaaataagaagaacttttgccgccaacctagaagaggccaacctgttgcctaagggcgatcccgaaagaagaagactactgtccatcgtggtggttggtggtggccctactggcgtagaagccgctggcgagctgcaggattatgttcaccaggacctgagaaagtttctccctgccctggccgaggaagtccagattcacttggtcgaagccctgcccatcgtgttgaatatgtttgagaaaaagctttcaagctacgcccagtcacatttagaaaacacttcgatcaaagtacacctgagaacggccgtcgccaaagttgaagaaaagcaactgctggccaagaccaaacacgaagacggtaaaataaccgaggaaactatcccatacggtaccctgatttgggccacgggtaacaaggcaagaccggtaatcaccgacctgttcaagaaaattcccgagcagaactcgtccaagagaggcttggcagtgaacgactttttgcaggtcaaaggcagcaacaacattttcgccattggcgacaatgcatttgccgggttgccaccaacagcccaagtagcgcaccaagaggccgaatatttggccaagaattttgacaaaatggctcaaataccaaatttccaaaagaacctgtcctccagaaaggataaaattgacctgttgttcgaggagaacaacttcaaacccttcaagtacaacgacttaggtgccttagcatacctgggatccgaaagagccattgcaaccatccgttccggcaagagaacattctacaccggtggtggcctgatgaccttctacttatggcggattttgtacctgtccatgattctgtctgcacgcagcagactgaaggtcttcttcgactggattaaattagcattcttcaaaagagacttttttgagggattatag

SEQ ID NO: 265 - DNA, 1542 bp, Artificial Sequence
  source: /note="Description of Artificial Sequence: Synthetic polynucleotide"
atgctatcgaagaatttgtacagtaacaagaggttgctgaccagcacgaacaccctagtcagattcgcctccaccagatccacaggcgtcgaaaacagcggagcaggtcccacatctttcaagaccatgaaagtcattgaccctcagcacagcgacaaaccaaacgtgctgatactgggttcgggctggggcgctatttcgtttttaaagcacattgacaccaagaagtacaacgtcagcatcatctctcccagaaagtatttcctgtttacgcctttgttacctagcgcaccagtggggacagtagacgaaaagtcaatcattgagcccatcgttaattttgctctcaagaaaaaggggaacgttacctactatgaggcagaagccacctctatcaatcccgacaggaataccgttaccatcaagagcttatctgccgtttcccagctataccagcctgaaaaccatctggggctgcaccaagccgaacccgccgaaattaagtacgactatttaatcagtgccgtaggtgcggaacctaacacctttggtattcctggggtgaccgactacggtcatttcctgaaggaaattcccaactctctggaaatacggagaacctttgccgccaatctagaggaggccaacttactgccaaagggtgatcccgaacggagaagactactgtccatcgtcgtggttggtggtgggcctactggtgtagaggccgctggtgaactgcaggattatgtgcaccaggacctgagaaagtttttccccgcattggccgaagaagtgcagattcacttggtcgaagccctgcccatcgttttgaatatgtttgagaagaagctttcaagctacgcgcagtcacatttagaaaacacttcgatcaaagtgcacctgagaacggctgtcgccaaggtggaagaaaagcaactgctggcaaagaccaaacacgaggacggtaagattaccgaggaaactattccctacggcactttgatttgggccacgggtaacaaggccagacccgtaatcactgaccttttcaagaaaattcctgagcaaaacagctccaagagaggcttggcagtgaatgactttttgcaggtgaaaggcagcaacaacattttcgccattggtgacaatgcatttgccggcctgccacctacagcccaagtggcccaccaagaggccgagtacttggccaagaacttcgataaaatggctcaaataccaaatttccagaagaatctatcttcaagaaaggataaaattgacctcttgttcgaggaaaacaactttaagcctttcaaatacaacgatctgggtgccttagcctacctgggatccgaaagggccattgcaaccatcagatccggtaagagaaccttttacaccggtggaggcttaatgaccttctacttatggcggatcctgtacttgagcatgattctaagcgccagatcgagattaaaggtgtttttcgactggattaagttagcatttttcaaaagagactttttcaaaggattatga

SEQ ID NO: 266 - DNA, 1542 bp, Artificial Sequence
  source: /note="Description of Artificial Sequence: Synthetic polynucleotide"
atgctatcgaagaatttgtacagcaaccggcggttgctcacctcgacgaatacgatggtccgcttcgcctccaccagatccacaggcgtggaaaactccggagcaggtcctacaagctttaagaccatgaaagtcatcgaccctcagcacagcgacaaaccaaacgtgctgatactgggttcggggtggggagctatttcgtttctgaagcacattgacaccaagaagtacaacgtttccatcatctctcctagaagctatttcctgtttacgcctttgttaccttctgccccagttgggacagtagacgaaaagtccattatcgagcccatcgttaattttgctctgaagaaaaaggggaacgtcacctactatgaggcagaggccacctctatcaatcccgacaggaacaccgtgaccataaaatcactgtctgccgtgtcccagctataccaacctgagaaccatctagggctgcaccaagccgaacctgccgagattaagtacgattatttaatcagcgctgtaggtgccgagcctaacacatttggtatccccggcgtcactgattacggccatttcctgaaagaaatccccaacagcttggaaatccggagaactttcgccgccaatctagagaaggctaacctgttgcctaagggtgaccccgaacggagaaggctactgtccatcgtggtcgttggtggtgggcccacaggtgtggaggccgctggcgagctgcaggattatgtgcaccaggacctgagaaagttcctccctgccttggccgaagaagtccaaattcacttggtcgaagccctgcccatcgtgttgaatatgtttgagaaaaagctgtcatcatacgcgcaatcacatttagaaaacacctccatcaaagtacatctgagaaccgctgtcgccaaggttgaagagaagcaactgctggccaagaccaaacacgaagacggtaaaataaccgaagaaactattccatacggtaccttgatttgggccacgggtaacaaggcaagaccggtaatcaccgacctgttcaagaaaattcctgagcaaaactcgagcaagagaggattggcagtgaatgacttcttgcaggtgaaaggcagcaacaacattttcgccattggtgacaacgcctttgctggcctgccaccaaccgcccaggtggcgcaccaggaggccgaatatttggccaagaatttcgacaaaatggcccaaatcccaaatttccaaaagaatctatcttccagaaaggataaaattgatctgttgttcgaggagaacaactttaaacctttcaaatacaacgatttaggtgccctggcatacctgggctccgaaagggccattgcaaccatccgttccggtaagagaaccttctacaccggtggtggcctgatgaccttctacttatggagaattttgtacctgtccatgattctatctgcaagaagcagattaaaggtgtttttcgactggattaagctggcatttttcaagagggacttttttgagggactgtga

SEQ ID NO: 267 - DNA, 1542 bp, Artificial Sequence
  source: /note="Description of Artificial Sequence: Synthetic polynucleotide"
atgctaagcaagaatttgtatagcaacaagcggttgctcacctcgacgaatacgctcgtccgcttcgcttccaccagatccacaggggtcgaaaacagcggagcaggtcccaccagctttaagaccatgaaagtcattgaccctcagcacagcgacaaacccaacgtgctgatactgggttcggggtggggagctattagctttctgaagcacattgacaccaagaagtacaacgtctccatcatctctcccagaagctatttcttacacacgcctttgctgcctagcgcacctgttggaacagtagacgagaagtcaatcattgagcccatcgttaattttgctctgaagaaaaaggggaacgttacctactatgaggcagaagccacctctatcaatcccgacaggaataccgttaccataaaatcattaagcgccgttagccagctgtaccagcctgaaaaccatctagggctgcaccaagcagaacctgccgaaattaagtacgattacctgatcagtgctgtaggcgcggagcctaacacctttggaattcctggggtgactgattacggtcacttcctgaaagaaattcccaactctttggaaatcagaagaacttttgccgccaatctagagaaggctaacctgctgccaaagggcgaccccgaacggagaagactactgtccattgtcgtggttggtggtgggcccactggtgtagaggccgctggcgagctgcaggattatgtgcaccaggacctgagaaagtttctccctgcattggccgaagaagtccaaattcacttggtcgaagccctgcccatcgtgttgaatatgttcgagaaaaagctgtcatcatacgcgcagtcacatttagaaaacacttccatcaaggtgcacctgagaacggccgtcgccaaggttgaagagaagcagctgttggccaagaccaaacacgaggacggtaaaataaccgaagaaaccattccatacggtaccttgatttgggccacgggtaacaaggccagaccggtaatcactgaccttttcaagaaaatccctgagcaaaactcgagcaagagaggattggcagtgaatgacttcttgcaggtcaaaggcagcaacaacatcttcgccattggcgacaatgcatttgctgggttgccaccaacagcccaagtagcgcaccaagaggccgagtatctggccaagaattttgataaaatggctcaaataccaaatttccaaaagaacctgtcctcacggaaggataaaattgacctgttgttcgaggagaacaacttcaaacctttcaaatacaacgacctgggcgccttagcatacctgggatccgaaagagccattgcaaccataagatccggcaagagaaccttctacaccggtggtggcttaatgaccttctacttatggcagattttgtacatgtccatgatcctatctgcccgctcgagattaaaggtctttttcgactggattaaattagcattcttcaagagggactttttcaagggattatga

SEQ ID NO: 268 - DNA, 1542 bp, Artificial Sequence
  source: /note="Description of Artificial Sequence: Synthetic polynucleotide"
atgctgtcgaagaacttgtacagtaacaagcggttgctcaccagcacgaatacgctcgtccgcttcgcttccaccagatccacaggggtggaaaactccggagcaggtcctacatcttttaagaccatgaaagtcattgaccctcagcacagcgacaaaccaaacgtgctgatactgggttctgggtggggcgccatctcgtttttaaagcacattgacaccaagaagtacaacgtttccatcatctctcccagaagctatttcttatttacgcccttgctgccctctgcaccagtgggaaccgtagacgaaaagtcaatcattgagcccatcgttaattttgctctcaagaaaaaggggaacgtcacctactatgaggcagaagccacctctatcaaccccgacaggaataccgttaccatcaagagcttatctgccgtgagccagctgtaccagcctgaaaaccatctaggcatgcatcaggcagaacctgctgaaattaagtacgactacttaatcagtgctgtaggtgcggaacctaacacatttggtattcctggcgtcactgactacggccacttcctgaaggaaatccccaactctttggaaataagacggacttttgccgccaacctagaggaggctaacttattgccaaagggtgatcccgagagaagaagactgctgtccattgtcgtggtgggtggagggcccacaggcgtagaggctgctggcgaactacaggattacgttcaccaggacctgagaaagtttctccccgcactggccgaagaagtccaaattcacttggtcgaagctctgcccatcgtgctgaatatgtttgagaaaaagctgtcatcatacgcgcaatcacatctggaaaacacttccatcaaggtgcatctgagaacggctgtggccaaagttgaagaaaagcaattgttggcaaagaccaaacacgaagacggtaagattaccgaagaaactattccatacggcactttgatttgggccacgggcaacaaggccagaccggtaatcactgaccttttcaagaaaattcctgagcaaaacagcagcaagagaggactggcagtgaatgactttttgcaggtgaaaggcagcaacaacattttcgccattggtgacaatgcatttgctggcttgcctcctaccgcccaagtagcccaccaagaggccgagtatatcgccaagaactttgataaaatggctcaaatacccaatttccagaagaacctatcctcaagaaaggataagatcgacctcctgttcgaggagaacaacttcaagcctttcaagtacaacgatttaggcgccttagcatacctgggctccgaaagagccattgcaaccataagatccggcaagagaaccttttacaccggtggtggcctgatgaccttctacttatggagaattttgtacttgtccatgattctatctgcccgcagcagattaaaggtctttttcgactggatcaagttagcctttttcaaaagggacttctttaaaggactgtag

SEQ ID NO: 269 - DNA, 1542 bp, Artificial Sequence
  source: /note="Description of Artificial Sequence: Synthetic polynucleotide"
atgctatcgaagaatttgtacagcaaccggcggctgctcacctcgacgaacaccctcgtcagattcgcctccaccagatccacaggggtggaaaacagcggagcaggtcctacctcttttaagaccatgaaagtcatcgacccccagcacagcgacaagcccaacgtgctgatactgggttctgggtggggcgccatttcgtttttaaagcacatcgacaccaagaagtacaacgtttccatcatctctcccagaagctatttcttatttacgcctctgttaccttctgccccagttgggacagtagacgagaagtccattattgagcccatcgtgaattttgctctcaagaaaaagggcaacgttacctactatgaggccgaagccaccagcatcaatcccgacaggaacaccgttaccataaaatcattaagcgccgtgagccagctataccagcctgaaaaccatctggggctgcaccaagccgaacctgctgaaattaagtacgattacttaatcagcgctgtaggcgcggagcctaacacatttggaatccctggcgtgactgattacggtcacttcctgaaggagatccccaacagcctggaaataagaagaacttttgccgccaatctagaggaggctaacttattgccaaagggtgatcccgaacggagaagactactgagcattgtggtggttggtggagggcctactggtgtagaagccgctggtgaactacaggattatgttcaccaggacctgagaaagtttctccccgcattggccgaagaagtccaaattcacctggtcgaagccctgcccatcgttttgaacatgtttgagaaagagcttagctcatacgcccaatcacatttagaaaacacctccatcaaagtgcatctgagaaccgccgtggccaaggtggaagagaagcaattgttggcaaagaccaaacacgaagacggtaaaataaccgaagaaactattccatacggtaccctgatttgggccacgggtaacaaggcaagacccgtaatcaccgacctgttcaagaagattcccgagcaaaactcgagcaagcggggattggcagtgaatgacttcttgcaggtgaaaggcagcaacaacatcttcgccattggcgacaatgcatttgctggcttgcctcctaccgcccaggtagcgcaccaagaggccgaatatttggccaagaactttgataagatggctcaaatacccaatttccaaaagaacctatcctcaagaaaggataaaattgatctcttgttcgaggaaaacaactttaaacctttcaaatacaacgatttaggtgccttagcatacctgggaagcgaaagggccattgcaaccatcagatccggcaagagaacattttacaccggtggtggcctgatgaccttctacttatggagaattttgtacttgtccatgattctgtctgccagatcgagattaaaggtctttttcgactggatcaagttagcatttttcaagagagacttttttaaaggactgtag

SEQ ID NO: 270 - DNA, 1542 bp, Artificial Sequence
  source: /note="Description of Artificial Sequence: Synthetic polynucleotide"
atgctgagcaagaacttgtatagtaacaagaggctgctcacctcgaccaatacgctcgtcagattcgctagcaccagatccacaggcgtcgaaaacagcggagcaggccctacatcttttaagaccatgaaagtcattgacccccagcacagcgacaaaccaaacgtgctgatcctgggttcggggtggggagccatttcgtttctgaagcacattgacaccaagaagtacaacgtctccatcatcagccccagaagctacttcctgcacacccccttgttaccctctgcacctgttgggacagtagacgaaaagtcaattattgagcccatcgttaatttcgccctcaagaaaaaggggaacgttacctactatgaggcagaagccacctctatcaatcccgacaggaataccgttaccataaaaagcttatctgccgtttcccagctgtaccaacctgagaaccatctggggctgcatcaagcagaacccgctgaaattaagtacgattacttaatcagcgctgtaggtgcggaacccaacacatttggtattcccggggtgactgactacggtcacttcttcaaggaaatccccaactctttggaaatacggagaacttttgccgccaatctggagaaggctaacttactgccaaagggcgaccccgaaagaagaagactactgtccattgtcgtcgtgggtggtggccccactggtgtagaggctgctggtgagctacaggattatgttcaccaggacctgagaaagttcctgcctgcattggccgaagaagtccaaattcacttggtcgaagctctgcccatcgtgttgaatatgttcgagaagaagctgtcatcatacgcgcaatcacatctggaaaacacttccatcaaagtacatctgagaacggctgtcgccaaagttgaagagaagcaattgctggcaaagaccaaacacgaagacggtaaaataaccgaggaaactatcccctacggcaccttgatttgggccaccggtaacaaggcaagaccggtaatcactgaccttttcaagaaaatccccgagcaaaactcgtccaagagaggattggcagtgaatgactttttgcaggtgaaaggcagcaacaacattttcgccatcggcgacaatgcatttgccgggttgccaccaaccgcccaggtagcgcaccaggaagccgaatatctggccaagaactttgataaaatggctcagatacccaatttccaaaagaacctatcctcacggaaggataagatcgatctcttgttcgaggagaacaactttaaacctttcaaatacaacgatctgggcgccttagcatacctgggaagcgaaagagccattgcaaccatacgttccggtaagagaacattttacaccggtggtggcttaatgaccttctacttatggagaatcttgtacatgagcatgattctatctgccagatcgagattaaaggtctttttcgactggatcaagctggcctttttcaagagagactttttcaaaggcttatag

SEQ ID NO: 271 - DNA, 1542 bp, Artificial Sequence
  source: /note="Description of Artificial Sequence: Synthetic polynucleotide"
atgctgtcgaagaatttgtatagcaacaagaggttgctcacctcgaccaatacgctagtcagattcgcttccaccagatccaccggggtggaaaactccggggcaggtcctacatcttttaagaccatgaaagtcattgacccccagcacagcgacaaaccaaacgtgctgatcctgggttctggctggggagccatctcgtttttaaagcacattgacaccaagaagtacaacgtttccatcatctctcctagaaagtatttcctgcacacgcctttgttaccttctgcaccagtgggaaccgtggacgaaaagtcaattattgagcccatcgttaattttgctctcaagaaaaaggggaacgttacctactacgaggcagaggccaccagcatcaatcccgaccggaacaccgtgaccatcaaatcattaagcgccgtgagccagctgtaccagcctgaaaaccacctaggcctgcatcaagcagaacccgctgaaattaagtacgattatttaatcagtgctgtgggtgcggaacctaacacctttggtatccccggggtcactgattacggtcatttcctgaaggaaattcccaactctctggaaatcagacggactttcgccgccaacctagagaaggccaacttattgccaaagggtgatcccgagcggagaagactactgtccattgtcgtcgtgggtggtgggcctactggtgtagaggccgctggcgagctacaggattacgttcaccaggacctgcggaagttcctccccgcattggccgaagaagtccagattcacttggtcgaagctctgcccatcgttctgaatatgtttgagaaaaagctttcatcatacgcgcaaagccatttagaaaacacttccatcaaagtacatctgagaaccgccgtcgccaaggtggaagagaagcaattgttggcaaagaccaaacacgaggacggtaaaattaccgaagaaactattccatacggcactttgatttgggccacgggcaacaaggcaagacccgtgatcaccgacctgttcaagaagattcctgagcaaaactcgagcaagagaggattggcagtgaatgactttttgcaggtcaaaggcagcaacaacattttcgccattggtgacaatgcatttgccgggctgccaccaacagcccaagtggcccaccaagaggccgagtatttggccaagaattttgacaaaatggcccagataccaaatttccaaaagaatctgtcttcaagaaaggataagattgatctcctgttcgaggaaaacaactttaaacccttcaaatacaacgatttaggtgccttagcatacctgggatccgaaagggccattgcaaccataagaagcggtaagcggaccttttacaccggtggtggcttaatgaccttctacttatggagaatcctgtacatgagcatgattctaagcgccagatcgagactgaaggtcttcttcgactggatcaagttagcctttttcaaaagagacttttttaaaggattatag

SEQ ID NO: 272 - DNA, 1542 bp, Artificial Sequence
  source: /note="Description of Artificial Sequence: Synthetic polynucleotide"
atgctatcgaagaatctgtatagtaaccggaggttgctgaccagcaccaataccctagtcagattcgcctccaccagatccacaggcgtggaaaactccggagctggccctacctcttttaagaccatgaaagtcatcgaccctcagcacagcgacaaaccaaacgtgctgatactgggttctgggtggggagccatctcgtttttaaagcacattgacaccaagaagtacaacgtttccatcatctctcctagaagctatttcttacacacgcccctgctgccttctgcccctgttgggacagtagacgaaaagtcaattatcgagcccatcgttaactttgctctcaagaaaaaggggaacgtcacctactacgaggcagaagccaccagcatcaatcccgacaggaataccgttaccatcaaaagcttaagcgccgtgtcccagctgtaccagcccgagaaccacctagggctgcatcaagcagaacctgccgaaattaagtacgattatttaatcagcgctgtaggcgccgaacccaacacatttggaatccctggggtcaccgattacggccatttcctgaaggaaatccccaacagcttggaaataagacggaccttcgccgccaatctagagaaggctaacttattgccaaagggtgaccccgaaagaagaaggctactgtccattgtcgtcgtgggcggtggccctacaggtgtggaagccgctggcgaactacaggactatgttcaccaggacctgagaaagttcctccctgcattggccgaggaagtccaaattcacttggtcgaagccctgcccatcgttttgaacatgtttgagaagaagctttcatcatacgcccaatcacatttagaaaacacctcgatcaaagtacacctgagaacggctgtcgccaaagtggaagaaaagcagttgttggcaaagaccaagcacgaagacggtaaaataaccgaggaaactattccatacggcactttgatttgggccaccggcaacaaggcaagaccggtaatcactgaccttttcaagaagattcccgagcagaactcgtccaagagaggactggcagtgaatgactttctgcaggtgaaaggcagcaacaacattttcgccattggtgacaatgcatttgccgggctgccaccaacagcccaagtggcgcaccaagaggccgaatatttggccaagaatttcgataaaatggctcagataccaaatttccaaaagaatctatcttcaagaaaggataaaattgatctcttgttcgaggagaacaactttaaacccttcaaatacaacgacttaggtgccttagcatacctgggctccgaaagggccattgcaaccataagatccggcaagagaacattttacaccggtggtggcttaatgaccttctacttatggcggatcctgtacctgtccatgatcctaagcgcaagatcgagattaaaggtctttttcgactggattaagttagcatttttcaaaagagacttctttgagggactgtag

SEQ ID NO: 273 - DNA, 1542 bp, Artificial Sequence
  source: /note="Description of Artificial Sequence: Synthetic polynucleotide"
atgctatcgaagaacttgtacagtaacaagaggttgctcacctcgacgaacaccctagtcagattcgcctccaccagatccacaggggtcgaaaactccggggcaggtcctacaagcttcaagaccatgaaagtcatcgaccctcagcacagcgacaaaccaaacgtgctgatcctgggttcgggctggggcgccatctcgtttttaaagcacattgacaccaagaagtacaacgttagcatcatcagccctagaaagtatttcttatttacgcccctgctgcctagcgcccctgttggaacagtagacgaaaagtcaatcattgagcccatcgttaatttcgctctcaagaaaaagggcaacgttacctactatgaggcagaggccacctctatcaaccccgaccggaacaccgttaccataaagtcattatctgccgttagccagctataccaacctgaaaaccatctaggcctgcaccaagcagaacctgctgaaattaagtacgattatttaatcagtgctgtaggcgcggaacctaacacatttggtatccctggcgtcaccgattacggccacttcctggaggaaattcccaactctttggaaataagacggacttttgccgccaatctagagaaggctaacttattgccaaagggtgatcccgaaagaagaaggctactgagcattgtcgtggttggtggtgggcctactggcgtagaggccgctggtgagctacaggattacgtgcaccaggacctgagaaagtttctgcctgccttggccgaggaagtgcaaattcacctggtcgaagctctgcccatcgttttgaacatgtttgagaaaaagctttcatcatacgcccagtcacatttagaaaacacctcgatcaaagtgcacctgagaacggctgtcgccaaggttgaagaaaagcaattgttggcaaagaccaagcacgaagacggtaaaataaccgaggaaaccatcccctacggtaccttgatttgggccacgggtaacaaggcaagaccggtaatcaccgacctgttcaagaaaatccctgagcaaaactcgtccaagcggggattggcagtgaatgactttttgcaggtcgagggcagcaacaacattttcgccattggtgacaacgcctttgccggcctgccacctacagcccaagtagcgcaccaggaagccgaatatttggccaagaattttgacaaaatggcccagatacccaatttccaaaagaatctgtcttcacggaaggataaaattgatctcttgttcgaggaaaacaactttaaacctttcaaatacaacgacttaggtgccctggcatacctgggcagcgaaagggccattgcaaccatacgttccggtaagagaacattttacaccggcggaggcctgatgaccttctacttatggagaatcttgtacctgtccatgattctatctgcaagatcgagactgaaggtgtttttcgactggattaagctggcatttttcaaaagagacttttttaaaggcttatag

SEQ ID NO: 274 - DNA, 1542 bp, Artificial Sequence
  source: /note="Description of Artificial Sequence: Synthetic polynucleotide"
atgctatcgaagaatttgtatagtaacaagaggttgctgacctcgaccaacacgctcgtcagattcgcttccaccagatccacaggcgtggaaaactccggagctggccctacctcttttaagaccatgaaagtcatcgaccctcagcacagcgacaaaccaaacgtgctgatactgggttctgggtggggagctattagctttctgaagcacattgacaccaagaagtacaacgtttccatcatctctcctagaagctatttcttattcacgcctctgatgccctctgccccagttggaacagtagacgaaaagtcaattatcgagcccatcgtgaattttgccctcaagaaaaaggggaacgtcacctactatgaggcagaagccacctctatcaatcccgacaggaataccgttaccataaaatcattatctgccgtgagccagctataccagcctgaaaaccacctggggctgcatcaagcagagcctgctgaaattaagtacgactacttaatcagtgctgtaggtgcggaacctaacacatttggaattcccggcgtcactgattacggtcatttcctgaaggagattcccaactctctggaaataagacggacctttgccgccaatctggaaaaggctaacttattgcctaagggcgaccccgaaagaagaagactgctgtccatcgtggtggttggtggtggccccacaggtgtagaggccgctggtgaactgcaggattatgttcaccaggacctgcggaagttcctccctgcactggccgaagaagtgcagattcacttggtcgaagctctgcccatcgttttgaatatgtttgagaaaaagctttcatcatacgcgcaatcacacctggaaaacacttccatcaaagtgcatctgagaaccgccgtcgccaaggttgaagaaaagcagctgctggcaaagaccaaacacgaagacggtaagattaccgaggaaactattccatacggtactttgatttgggccaccggtaacaaggcaagaccggtaatcactgacctgttcaagaagattcccgagcaaaactcgagcaagagaggactggccgtgaatgactttttgcaggtcaaaggcagcaacaacatcttcgccattggtgacaacgcctttagcggcctgcctcctacagcccaagtagcccaccaagaggccgaatatttggccaagaattttgataagatggctcaaataccaaatttccaaaagaatctatcttccagaaaggataaaattgatctcttgttcgaggagaacaactttaaacctttcaaatacaacgacttaggtgccctggcctacctgggatccgaaagggccattgccaccataagatccggtaagagaacattttacaccggtggtggcttaatgaccttctacttatggagaatcttgtacatgtccatgatcctatctgccagaagcagattaaaggtgttcttcgactggattaagttagcctttttcaaaagagacttttttaaaggattatga

SEQ ID NO: 275 - DNA, 1542 bp, Artificial Sequence
  source: /note="Description of Artificial Sequence: Synthetic polynucleotide"
atgctaagcaagaacttgtatagcaacaagaggttgctcaccagcacgaacacgctcgtcagattcgcttccaccagatccaccggggtcgaaaacagcggagcaggtcccacaagctttaagaccatgaaggtcattgaccctcagcacagcgacaaaccaaacgtgctgatcctgggttctggctggggcgctattagctttttaaagcacattgacaccaagaagtacaacgtttccatcatctctcccagaagctatttcctgtttacccctttgttaccttctgcaccagttggaacagtagacgaaaagtccatcattgagcccatcgttaatttcgctctcaagaaaaaggggaacgttacctactatgaggcagaagccacctctatcaatcccgacaggaataccgtgaccataaagtcactgtctgccgttagccagctataccaacctgaaaaccatctagggctgcatcaagccgaacctgctgaaattaagtacgattacctgatcagcgctgtaggtgccgaacccaacacatttggtattcccggggtcaccgactacggtcatttcctgaaggagattcccaactctttggaaatacggagaacttttgccgccaatctagagaaggctaacttactgccaaagggcgaccccgagagaagaagactactgtccattgtggtcgttggtggaggccccactggcgtggaagctgctggtgagctacaggattatgttcaccaggacctgagaaagtttctgcctgcattggccgaagaagtccaaattcacttggtcgaagctctgcccatcgttctgaacatgtttgagaaaaagctttcatcatacgcgcaatcacacctggaaaacacctcgatcaaggtacatctgagaacggctgtcgccaaagttgaagaaaagcaattgttggcaaagaccaagcacgaagacggtaagattaccgaagaaactattccatacggtactctgatttgggccaccggcaacaaggccagaccggtgatcactgacctgttcaagaagatccctgagcaaaacagctccaagagaggactggcagtgaatgactttttgcaggtcaaaggcagcaacaacattttcgccattggtgacaatgcatttagcgggctgccaccaaccgcccaagtagcccaccaggaggccgaatatatcgccaagaatttcgacaagatggcccaaataccaaatttccaaaagaatctgtcctccagaaaggataaaattgacctcttgttcgaggaaaacaacttcaaacctttcaagtacaacgatttaggtgccttagcatacctgggatccgaaagagccattgcaaccatccgttccggcaagagaaccttttacaccggtggtggcttaatgaccttctacttatggagaatcctgtacttgagcatgattctaagcgcacgctcgagattaaaggtctttttcgactggattaaaatggcatttttcaagagagacttcttcaaaggattatag

SEQ ID NO: 276 - DNA, 1542 bp, Artificial Sequence
  source: /note="Description of Artificial Sequence: Synthetic polynucleotide"
atgctatcgaagaatttgtacagtaacaagcggttgctgaccagcacgaatacgctagtcagattcgcctccaccagatccacaggcgtggaaaacagcggagcaggtcctacctctttcaagaccatgaaagtcatcgacccccagcacagcgacaaaccaaacgtgctgatcctgggttcggggtggggcgctatttcgtttctgaagcacatcgacaccaagaagtacaacgtttccatcatctctcctagaagctatttcttatttacccctttgatgccttctgcaccagttgggaccgtagacgaaaagtccattattgagcccatcgttaatttcgccctgaagaaaaaggggaacgtcacctactatgaggccgaggccaccagcatcaatcccgaccggaataccgttaccataaaatcactgtctgccgtgagccagctgtaccaacctgaaaaccacctagggctgcatcaggcagaacccgccgaaattaagtacgattacttaatcagcgctgtaggtgccgagcctaacacatttggaattcctggggtcactgattacggtcatttcctgaaagaaattcccaacagcttggaaataagacggacttttgccgccaatctggagaaggctaacctgctgccaaagggtgatcccgaaagaagaagactgctgtccattgtggtggttggtggtggccctactggtgtagaggctgctggtgaactgcaggattatgttcaccaggacctgagaaagtttctccccgcattggccgaagaagtgcaaattcacctggtcgaagctctgcccatcgttttgaatatgtttgagaaaaagctgtcatcatacgcgcaaagccatttagaaaacacttcgatcaaggtacacctgagaacggccgtcgccaaagttgaagaaaagcaattgttggccaagaccaaacacgaagacggtaagataaccgaagaaactattccatacggtactctgatttgggccacgggtaacaaggcaagaccggtgatcactgaccttttcaagaaaattcccgagcagaactcgagcaagcggggcctggcagtgaatgacttcctgcaggtgaaaggcagcaacaacatcttcgccattggtgacaacgcctttagcgggttgcctcctaccgcccaagtagcgcaccaggaggccgagtatctggccaagaactttgataagatggctcagatcccaaatttccaaaagaatctatcttcaagaaaggataaaattgatctcctgttcgaggagaacaactttaaacctttcaaatacaacgatttaggtgccttagcatacctgggctccgaaagggccattgccaccatcagatccggcaagagaaccttctacaccggtggtggcctgatgaccttctacctgtggcagattttgtacttgtccatgattctgtctgccagaagcagattaaaggtctttttcgactggattaaattagcatttttcaaaagggacttctttaaaggcttatga

SEQ ID NO: 277 - DNA, 1542 bp, Artificial Sequence
  source: /note="Description of Artificial Sequence: Synthetic polynucleotide"
atgctatcgaagaatttgtatagtaacaagaggttgctgaccagcaccaataccctcgtgagattcgccagcaccagatccacaggcgtggaaaactccggggcaggtcccacatctttcaagaccatgaaagtcatcgaccctcagcacagcgacaagcccaacgtgctgatactgggttcggggtggggagctatttcgtttttaaagcacattgacaccaagaagtacaacgtttccatcatcagccctagaagctatttcctgtttacgcccttgttaccttctgccccagtggggacagtagacgagaagtcaattattgagcccatcgtgaacttcgccctgaagaaaaagggcaacgttacctactacgaggccgaagccacctctatcaatcccgaccggaacaccgttaccataaaaaacctgagcgccgtttcccagctataccagcctgaaaaccatctgggcatgcatcaggcagaacccgctgaaattaagtacgattatttaatcagtgctgtaggtgcggagcctaacacctttggtattcccggcgtcactgattacggtcatttcctgaaagaaattcccaactctctggaaataagaagaacttttgccgccaatctagagaaggctaacctgttgccaaagggtgaccccgagagaagaagactgctgagcattgtcgtggtgggtggtgggcctactggtgtagaggccgctggcgaactacaggattacgttcaccaggacctgagaaagtttctccctgcattggccgaggaagtccaaattcacttggtcgaagctctgcccatcgttttgaatatgtttgagaaaaagctttcatcatacgcccaatcacatttagaaaacacttcgatcaaagtgcatctgagaaccgccgtcgccaaggttgaagaaaagcaattgttggcaaagaccaaacacgaggacggcaaaattaccgaagaaactattccctacggtactttgatttgggccaccggtaacaaggcaagaccggtaatcactgaccttttcaagaaaatccctgagcagaactcgagcaagcggggactggccgtgaacgactttttgcaggtgaaaggcagcaacaacattttcgccatcggcgacaatgcatttgccggcctgcctccaaccgcccaagtagcccaccaagaggccgaatatttggccaagaattttgataaaatggcccaaatacccaatttccagaagaatctatcctccagaaaggataaaattgatctcctgttcgaggagaacaactttaagcccttcaaatacaacgacttaggtgccttagcatacctgggatccgaaagggccattgccaccatccgttccggtaagagaacattttacaccggtggtggcttaatgaccttctacttatggagaatcttgtacctgagcatgattctatctgcaagatcgagattaaaggtgtttttcgactggattaaaatggcattcttcaagagggacttctttaaaggactgtag

SEQ ID NO: 278 - DNA, 1542 bp, Artificial Sequence
  source: /note="Description of Artificial Sequence: Synthetic polynucleotide"
atgctaagcaagaatttgtacagtaacaagcggctgctgacctcgaccaatacgctagtgagattcgcctccaccagatccacaggggtcgaaaactccggggcaggtcctacatcttttaagaccatgaaagtcattgaccctcagcacagcgacaaaccaaacgtgctgatactgggttcggggtggggcgctatttcgtttttaaagcacatcgacaccaagaagtacaacgtcagcatcatctctcccagaagctatttcttatttacgcccttgctgccctctgcacctgttgggacagtggacgaaaagtcaatcattgagcccatcgttaattttgctctcaagaaaaaggggaacgtcacctactatgaggccgaagccacctctatcaatcccgacaggaataccgtgaccatcaaaaacttatctgccgtgtcccagctgtaccagcctgaaaaccatctggggatgcaccaggcagaacccgctgaaattaagtacgactatttaatcagtgctgtgggcgccgagcccaacacctttggtattcccggggtcactgattacggtcatttcctgaaggagattcccaactctttggaaataagacggacctttgccgccaacctagaaaaggctaacttactgccaaagggtgatcccgagcggagaagactactgtccattgtcgtcgttggcggtgggcctactggcgtggaggccgctggtgagctacaggattatgtgcaccaggacctgagaaagtttttccctgcattggccgaagaagtccaaattcacttggtggaagctctgcccatcgttttgaatatgttcgagaaaaagctgtcatcatacgcgcaatcacatttagaaaacacttccatcaaagtacatctgagaaccgccgtggccaaagtggaagaaaagcaattgttggccaagaccaaacacgaagacggtaaaataaccgaagaaactatcccctacggtactctgatttgggccacgggtaacaaggccagacccgtaatcactgaccttttcaagaaaatccccgagcaaaactcgtccaagcggggattggccgtgaatgactttttgcaggtgaaaggcagcaacaacatcttcgccattggcgacaacgcatttgccgggttgccacctaccgcccaagtagcgcaccaggaagccgaatatttggccaagaattttgataaaatggcccaaatacccaatttccaaaagaacctatcttcacggaaggataaaattgacctcttgttcgaggagaacaacttcaaacccttcaaatacaacgatttaggtgccctggcctacctgggatccgaaagggccattgcaaccatacgtagcggtaagagaacattttacaccggtggtggcctgatgaccttctacttatggagaatcctgtacttgtccatgattctaagcgcacgctcgagattaaaggtcttcttcgactggattaaattagcattcttcaaaagagacttctttaaaggactgtag

SEQ ID NO: 279 - DNA, 1542 bp, Artificial Sequence
  source: /note="Description of Artificial Sequence: Synthetic polynucleotide"
atgctaagcaagaatctgtacagtaaccggaggttgctcacctcgacgaatacgctagtcagattcgctagcaccagatccacaggggtcgaaaactccggagcaggccctacatcttttaagaccatgaaagtcattgaccctcagcacagcgacaaaccaaacgtgctgatactgggttcggggtggggagctattagctttttaaagcacattgacaccaagaagtacaacgtctccatcatctctcctagaagctatttcttatttacgcccttgttacccagcgcaccagtggggacagtagacgagaagtcaatcattgagcccatcgttaattttgctctcaagaaaaaggggaacgttacctactatgaggcagaagccacctctatcaatcccgaccggaataccgtgaccataaaaaacttaagcgccgtgtcccagctataccaacctgagaaccatctaggcctgcatcaggccgagcccgctgagattaagtacgactacttaatcagtgccgtaggcgccgaacctaacacatttggaattcctggggtgactgattacggtcatttcctgaaggaaattcccaactctttggaaataagaagaacctttgccgccaacctagagaaggctaacttactgccaaagggtgaccccgaaagaagaagactgctgtccattgtggtggtgggtggtgggcctactggtgtagaggccgctggtgaactgcaggattatgttcaccaggacctgagaaagttcttccccgcactggccgaagaagtccaaattcacttggtcgaagccctgcccatcgttctgaatatgtttgagaaaaagctgagctcatacgcccaaagccatctggaaaacacttcgatcaaagtgcatctgagaacggctgtcgccaaagttgaagaaaagcaattgttggccaagaccaaacacgaagacggtaaaataaccgaagaaaccattccatacggcactttgatttgggccacgggcaacaaggcaagaccggtaatcaccgacctgttcaagaaaattcctgagcaaaactcgagcaagcggggcctggccgtgaacgactttttgcaggtgaaaggcagcaacaacattttcgccatcggtgacaatgcatttgccggcttgccaccaaccgcccaagtagcccaccaggaagccgagtatttggccaagaatttcgataaaatggcccaaataccaaatttccagaagaatctatcttcccggaaggataaaatcgatctcttgttcgaggagaacaactttaagcccttcaaatacaacgacctgggtgccttagcctacctgggatccgaaagagccattgcaaccataagatccggtaagcggaccttttacaccggtggtggcctgatgaccttctacctgtggagaattttgtacttgagcatgatcctaagcgcaagatcgagactgaaggtgtttttcgactggatcaaattagcattcttcaagagagacttcttcaagggcttatag

SEQ ID NO: 280 - DNA, 1542 bp, Artificial Sequence
  source: /note="Description of Artificial Sequence: Synthetic polynucleotide"
atgctatcgaagaatttgtatagtaaccggaggttgctcacctcgacgaataccctagtccgcttcgctagcaccagatccacaggggtggaaaactccggagcaggtcctacaagctttaagaccatgaaggtcatcgaccctcagcacagcgacaaaccaaacgtgctgatcctgggttcgggctggggcgctatctcgtttttaaagcacattgacaccaagaagtacaacgttagcatcatctctcctagaagctacttcttattcacccctttgttaccctctgcccctgtggggaccgtggacgaaaagtcaattattgagcccatcgttaatttcgccctcaagaaaaaggggaacgtcacctactatgaggccgaagccacctctatcaaccccgaccggaataccgttaccataaagaacttatctgccgttagccagctgtaccagcctgaaaaccatctagggctgcaccaagcagagcccgctgaaattaagtacgattatttaatcagcgccgtaggcgcggaacccaacacatttggtattcctggggtgaccgattacggtcatttcctgaaggaaattcccaacagcttggaaataagacggactttcgccgccaatctggagaaggctaacttactgccaaagggtgatcccgagagaagaaggctactgtccattgtcgtcgttggcggtgggcccactggtgtagaagccgctggtgaactacaggactatgttcaccaggacctgagaaagttcctgcccgcattggccgaggaagtccagattcacctggtcgaagctctgcccatcgttttgaacatgtttgagaaagagcttagctcatacgcgcaatcacatttagaaaacacttccatcaaagtacacctgagaaccgctgtcgccaaggtggaagaaaagcaattgctggcaaagaccaaacacgaagacggtaaaataaccgaagaaactatcccatacggtaccttgatttgggccacgggtaacaaggcaagaccggtgatcactgaccttttcaagaaaatccctgagcaaaacagctccaagcggggcttggccgtgaatgactttttgcaggtgaaaggcagcaacaacattttcgccattggcgacaatgcctttgccgggttgccacctaccgcccaagtagcgcaccaagaggccgaatatttggccaagaactttgataaaatggctcaaataccaaatttccaaaagaacctgtcttcccggaaggataaaattgacctcttgttcgaggaaaacaacttcaaacctttcaaatacaacgatttaggcgccttagcctacctgggaagcgaaagggccattgcaaccatccgttccggtaagcggaccttttacaccggtggaggcttaatgaccttctacctgtggcggatcctgtacttgagcatgattctaagcgcacgctcgagattaaaggtctttttcgactggattaagttagcatttttcaaaagagacttttttaaaggattatag

SEQ ID NO: 281 - DNA, 1542 bp, Artificial Sequence
  source: /note="Description of Artificial Sequence: Synthetic polynucleotide"
atgctatcgaagaatttgtacagtaacaagaggctgctgacctcgaccaataccatggtcagattcgcttccaccagatccaccggggtggaaaactccggagcaggccctacatcttttaagaccatgaaagtcatcgaccctcagcacagcgacaaaccaaacgtgctgatcctgggttcggggtggggagctatttcgtttctgaagcacattgacaccaagaagtacaacgtcagcatcatctctcctagaaagtatttcttattcacccctttgctgcctagcgcaccagttggaaccgtagacgagaagtcaattatcgagcccatcgttaatttcgctctcaagaaaaaggggaacgttacctactatgaggcagaagccacctctatcaatcccgaccggaacaccgttaccataaaatcattaagcgccgtttcccagctgtaccaacccgaaaaccacctagggctgcaccaagcagaacctgctgaaattaagtacgattatctgatcagtgccgtaggtgccgagcctaacacatttggaattcctggcgtgaccgattacggtcatttcttcaaagagattcccaactctttggaaataagacggacttttgccgccaacctggagaaggctaacttattgccaaagggtgatcccgagagaagaagactgctgagcatcgtcgtggttggcggtggccctacaggtgtagaggctgctggtgaactacaggactatgtgcaccaggacctgagaaagttcctccctgcattggccgaagaagtccaaattcacttggtggaagctctgcccatcgtgctgaatatgtttgagaagaagctgtcatcatacgcgcaatcacacttagaaaacacctcgatcaaagtacatctgagaacggctgtggccaaagtggaagagaagcaattgttggcaaagaccaagcacgaggacggtaagataaccgaagaaaccatcccctacggcactttgatttgggccacgggtaacaaggccagaccggtaatcaccgacctgttcaagaaaattcccgagcagaacagctccaagagaggcctggcagtgaatgactttttgcaggtgaaaggcagcaacaacattttcgccatcggtgacaacgcatttgctgggctgccacctacagcccaagtagcgcaccaagaggccgaatatttggccaagaattttgataagatggcccagatcccaaatttccaaaagaacctatcttcacggaaggataaaattgatctcttgttcgaggaaaacaacttcaaacctttcaagtacaacgatttaggcgccttagcctacctgggatccgaaagggccattgcaaccatacgttccggtaagagaaccttttacaccggtggtggcttaatgaccttctacttatggagaattttgtacttgtccatgattctgtctgccagatcgagattaaaggtctttttcgactggatcaaattagcatttttcaaaagagacttttttaaaggcttatag

SEQ ID NO: 282 - DNA, 1542 bp, Artificial Sequence
  source: /note="Description of Artificial Sequence: Synthetic polynucleotide"
atgctatcgaagaacttgtatagtaacaagaggttgctcaccagcacgaatacgctcgtcagattcgcctccaccagatccacaggggtggaaaactccggagctggtcccacatctttcaagaccatgaaagtcattgaccctcagcacagcgacaagcccaacgtgctgatcctgggttcgggctggggagctattagctttttaaagcacattgacaccaagaagtacaacgtctccatcatcagccccagaagctacttcttacacacgcctttgctgcctagcgccccagttgggacagtagacgaaaagtcaattattgagcccatcgtgaactttgccctgaagaaaaaggggaacgttacctactacgaggcagaggccacctctatcaatcccgacaggaataccgttaccatcaaatcattatctgccgttagccagctgtaccaacctgaaaaccacctaggcatgcaccaagccgaacctgctgagattaagtacgattatttaatcagtgccgtaggtgcggagcctaacacatttggaatccctggggtcaccgattacggtcacttcctgaaagaaattcccaacagcttggaaatcagacggacttttgccgccaatctggagaaggctaacttattgccaaagggtgatcccgagagaagaaggctactgtccattgtggtggttggtggtgggcctactggtgtagaggccgctggcgaactacaggattatgttcaccaggacctgcggaagtttctgcccgccttggccgaagaagtccaaattcacttggtggaagccctgcccatcgttctgaacatgtttgagaaaaagctttcatcatacgcgcaatcacatctggaaaacacttcgatcaaagtacacctgagaaccgctgtcgccaaggttgaagagaagcaattgttggccaagaccaaacacgaagacggtaaaattaccgaagaaactatcccatacggtaccttgatttgggccacgggtaacaaggcaagacccgtgatcaccgaccttttcaagaaaattcccgagcaaaactcgtccaagagaggcttggcagtgaacgactttttgcaggtggagggcagcaacaacattttcgccattggtgacaacgcatttgctgggttgcctccaacagcccaggtagcgcaccaagaggccgaatatctggccaagaattttgacaagatggcccaaataccaaatttccaaaagaacctatcttcaagaaaggataaaatcgatctcctgttcgaggagaacaacttcaaacctttcaagtacaacgatctgggtgccttagcctacctgggatccgaaagggccattgcaaccataagaagcggtaagagaacattctacaccggtggtggcttaatgaccttctacttatggagaattctgtacctgagcatgatcctaagcgccagatcgagattaaaggtgttcttcgactggatcaagttagcatttttcaaaagagacttttttaaaggactgtga

SEQ ID NO: 283 - DNA, 1542 bp, Artificial Sequence
  source: /note="Description of Artificial Sequence: Synthetic polynucleotide"
atgctaagcaagaatttgtatagtaacaagcggctgctgacctcgaccaataccctagtccgcttcgcttccaccagatccacaggcgtggaaaactccggagctggccctaccagctttaagaccatgaaggtcattgacccccagcacagcgacaaacccaacgtgctgatactgggttctggctggggagctatctcgtttctgaagcacattgacaccaagaagtacaacgtcagcatcatctctcctagaagctatttcttacacacgcctttgttaccctctgcaccagttgggacagtagacgagaagtcaattattgagcccatcgtgaattttgctctcaagaaaaaggggaacgttacctactacgaggcagaagccacctctatcaatcccgacaggaataccgttaccataaagaacttaagcgccgtttcccagctgtaccaacctgaaaaccatctagggatgcaccaggccgaacctgctgagattaagtacgattatctgatcagtgctgtaggtgcggaacctaacacatttggtatccctggcgtcactgattacggtcatttcctgaaggagattcccaacagcttggaaataagacggacttttgccgccaatctagagaaggctaacttactgcctaagggtgatcccgagcggagaaggctactgagcattgtggtggtgggtggagggcctactggtgtggaggctgctggtgaactgcaggattacgtgcaccaggacctgcggaagtttctccctgcattggccgaagaagtccaaattcacctggtcgaagctctgcccatcgtgttgaatatgttcgagaaaaagcttagctcatacgcgcagtcacacctggaaaacacttcgatcaaggtgcatctgagaacggctgtcgccaaagtggaagaaaagcaattgctggcaaagaccaagcacgaggacggtaaaataaccgaggaaaccattccctacggcaccttgatttgggccacgggtaacaaggccagacccgtaatcactgaccttttcaagaagatccctgagcagaactcgtccaagagaggattggcagtgaacgactttctgcaggtgaaaggcagcaacaacattttcgccattggtgacaatgcctttgctgggttgccaccaacagcccaagtggcccaccaagaggccgaatatctggccaagaactttgataaaatggcccaaatacccaatttccagaagaatctatcttcaagaaaggataaaattgatctcttgttcgaggaaaacaactttaaacccttcaaatacaacgatttaggtgccttagcctacctgggatccgaaagggccattgcaaccatacgtagcggtaagcggaccttttacaccggcggtggcttaatgaccttctacttatggagaattttgtacttgtccatgattctatctgcaagatcgagattaaaggtctttttcgactggattaaattagcatttttcaaaagggacttctttaaaggactgtga

SEQ ID NO: 284 - DNA, 1542 bp, Artificial Sequence
  source: /note="Description of Artificial Sequence: Synthetic polynucleotide"
atgctatcgaagaatctgtatagtaaccggcggctgctcaccagcacgaataccctcgtgcgcttcgctagcaccagatccacaggggtggaaaactccggggcaggtcccacctcttttaagaccatgaaagtcatcgacccccagcacagcgacaagccaaacgtgctgatcctgggttctgggtggggcgctatcagctttctgaagcacattgacaccaagaagtacaacgtcagcatcatcagccccagaagctacttcctgttcacccctttgatgcctagcgcacctgttgggacagtagacgagaagtcaattatcgagcccatcgtgaacttcgccctgaagaaaaaggggaacgttacctactatgaggccgaggccaccagcatcaaccccgaccggaacaccgtgaccataaaaagcttaagcgccgtgtcccagctgtaccagcccgagaaccacctgggcctgcaccaagcagagcccgccgagattaagtacgactacctgatcagcgccgtgggcgccgaacccaacacctttggaatccctggcgtcaccgattacggccacttcctgaaagaaatccccaacagcttggaaataagaagaaccttcgccgccaacctagaaaaggctaacttactgccaaagggtgaccccgagcggagaaggctgctgagcatcgtcgtggtgggcggagggcctacaggcgtggaagctgctggcgaactacaggactacgtgcaccaggacctgcggaagtttctgcccgcactggccgaggaagtgcagattcacctggtcgaagccctgcccatcgttttgaacatgttcgagaagaagctgtcatcatacgcccaaagccacctggaaaacacctccatcaaggtacatctgagaaccgccgtcgccaaagttgaagaaaagcagctgttggccaagaccaagcacgaagacggtaagattaccgaagaaaccatcccatacggcaccctgatttgggccacgggtaacaaggccagaccggtaatcaccgacctgttcaagaaaattcccgagcaaaactcgtccaagagaggcctggccgtgaatgacttcttgcaggtcgagggcagcaacaacatcttcgccattggtgacaacgcctttgccggcctgccacctaccgcccaggtggcccaccaggaagccgaatacctggccaagaactttgacaaaatggcccagatccccaatttccaaaagaacctatcttccagaaaggataagatcgatctcctgttcgaggaaaacaacttcaaacctttcaaatacaacgatctgggtgccttagcctacctgggatccgaaagagccattgccaccatacgttccggtaagagaacattctacaccggcggaggcctgatgaccttctacttatggagaatcctgtacttgagcatgattctgagcgcacgcagcagactgaaggtgttcttcgactggattaaactggccttcttcaaaagggacttttttaagggcctgtga

SEQ ID NO: 285 - DNA, 1542 bp, Artificial Sequence
  source: /note="Description of Artificial Sequence: Synthetic polynucleotide"
atgctgagcaagaacctgtacagcaacaagcggttgctcacctcgaccaacaccctagtgagattcgccagcaccagatccaccggcgtggaaaactccggggctggtcccaccagctttaagaccatgaaagtcatcgaccctcagcacagcgacaagccaaacgtgctgatcctgggctctgggtggggcgctatcagctttctgaagcacattgacaccaagaagtacaacgttagcatcatcagccccagaaagtacttcttatttacgcccttgctgccctctgcccctgtgggaaccgtggacgaaaagtccatcattgagcccatcgttaatttcgccctgaagaaaaagggcaacgttacctactatgaggccgaagccaccagcatcaaccccgacaggaataccgtgaccatcaagagcttaagcgccgtgtcccagctgtaccagcccgaaaaccatctgggcctgcaccaagccgaacctgctgagattaagtacgattacttaatcagcgccgtaggtgccgagcccaacacctttggaatccccggcgtcactgactacggtcatttcctggaggagattcccaactctctggaaatcagacggaccttcgccgccaatctagagaaggccaacctgctgccaaagggtgatcccgagagaagaaggctgctgagcatcgtggtggtgggcggtgggcctacaggcgtagaggccgctggcgagctgcaggattatgtgcaccaggacctgcggaagttcttccctgcactggccgaggaagtccagattcacttggtcgaagccctgcccatcgtgctgaatatgttcgagaagaagcttagctcatacgcccaaagccatttagaaaacacttccatcaaggtgcacctgagaaccgccgtggccaaggttgaagaaaagcagttgctggcaaagaccaagcacgaagacggtaaaattaccgaggaaaccattccatacggtactctgatttgggccaccggcaacaaggcaagacccgtaatcaccgacctgttcaagaaaattcccgagcagaacagcagcaagagaggcctggcagtgaacgacttcctgcaggtcaaaggcagcaacaacattttcgccatcggcgacaacgcatttgctggcctgcctccaacagcccaagtggcccaccaagaggccgagtatttggccaagaacttcgataaaatggcccagatccccaatttccagaagaacctatcttcccggaaggataagattgacctgttgttcgaggaaaacaactttaagcctttcaagtacaacgatttaggcgccctggcctacctgggaagcgaaagagccattgccaccataagatccggcaagcggacattctacaccggcggtggcctgatgaccttctacttatggcggatcctgtacctgagcatgattctgtctgcccgcagcagactgaaggtgtttttcgactggatcaagctggcctttttcaaaagggacttctttaagggattatag

SEQ ID NO: 286 - DNA, 1542 bp, Artificial Sequence
  source: /note="Description of Artificial Sequence: Synthetic polynucleotide"
atgctgagcaagaatctgtatagtaacaagaggctgctcacctcgaccaacaccctagtgagattcgctagcaccagatccacaggcgtggaaaactccggggcaggccctacctctttcaagaccatgaaggtcatcgacccccagcacagcgacaaaccaaacgtgctgatcctgggttctgggtggggagccatctcgtttttaaagcacatcgacaccaagaagtacaacgtcagcatcatcagccctagaaagtatttcctgttcacccccttgttacccagcgccccagtgggaaccgtagacgagaagtccattattgagcccatcgtgaatttcgctctgaagaaaaaggggaacgttacctactatgaggccgaggccaccagcatcaaccccgaccggaacaccgtgaccataaaatcattaagcgccgtgagccagctgtaccagcctgaaaaccacctgggcctgcaccaggccgaacccgctgagattaagtacgactacttaatcagcgctgtaggtgcggagcccaacacctttggtattcctggcgtgactgattacggccatttcctgaaagaaattcccaactctttggaaatccggcggactttcgccgccaacctggaaaaggctaacttactgcctaagggtgaccccgagagaagaaggctgctgtccatcgtcgtcgtgggcggaggccccactggcgtggaggctgctggtgaactacaggactacgttcaccaggacctgagaaagtttttccctgcactggccgaagaagtgcaaattcacctggtggaagccctgcccatcgtgctgaacatgttcgagaaaaagctgagcagctacgcccaatcacatttagaaaacacctccatcaaagtgcacctgagaacggctgtcgccaaggttgaagaaaagcagttgctggccaagaccaagcacgaggacggcaagataaccgaggaaaccatcccctacggcaccctgatttgggccaccggtaacaaggccagacccgtgatcaccgaccttttcaagaagatccccgagcagaacagcagcaagcggggactggccgtgaacgactttctgcaggtgaaaggcagcaacaacattttcgccatcggcgacaacgcatttgctggcttgccacctaccgcccaagtagcccaccaggaggccgaatatctggccaagaatttcgacaaaatggctcagatacccaatttccaaaagaatctatcctcccggaaggataaaatcgacctcctgttcgaggaaaacaacttcaagcccttcaaatacaacgatctgggcgccctggcctacctgggcagcgaaagagccattgccaccatcagatccggcaagcggacattctacaccggcggaggcttaatgaccttctacctgtggagaatcctgtacttgagcatgattctgagcgcacgcagcagactgaaggtgttcttcgactggattaagctggcattcttcaagagggacttcttcgagggcttatag

SEQ ID NO: 287 - DNA, 1542 bp, Artificial Sequence
  source: /note="Description of Artificial Sequence: Synthetic polynucleotide"
atgctaagcaagaacctgtacagcaacaagaggttgctgaccagcacgaacaccctcgtcagattcgcttccaccagatccacaggcgtcgaaaactccggggctggccctacctctttcaagaccatgaaggtcatcgacccccagcacagcgacaagccaaacgtgctgatcctgggctcgggctggggcgctatcagctttctgaagcacattgacaccaagaagtacaacgtcagcatcatcagccctagaagctacttcctgtttacccctctgctgcctagcgcccctgtgggaaccgtagacgagaagtcaattattgagcccatcgttaacttcgccctgaagaaaaagggcaacgtcacctactatgaggcagaggccacctctatcaaccccgacaggaacaccgtgaccatcaaaagcctgtctgccgtgtcccagctgtaccagcctgaaaaccacctgggcatgcaccaggcagagcccgccgagattaagtacgattacttaatcagcgccgtaggcgccgagcctaacacctttggaattcctggcgtgaccgactacggtcatttcctgaaggaaatccccaactctttggaaataagaagaaccttcgccgccaacctggagaaggccaacttactgcctaagggtgaccccgagcggagaagactactgagcatcgtggtggtgggtggtggccccacaggcgtggaggctgctggcgagctgcaggactacgtgcaccaggacctgcggaagttcctgcccgcattggccgaggaagtccagattcacctggtggaagctctgcccatcgttttgaacatgtttgagaagaagcttagcagctacgcccaaagccacctggaaaacacttccatcaaggtacacctgagaaccgccgtggccaaggtggaagaaaagcaattgctggccaagaccaagcacgaggacggcaaaattaccgaagaaactatcccctacggtaccttgatttgggccaccggcaacaaggccagaccggtaatcaccgacctgttcaagaaaattcccgagcaaaacagcagcaagagaggactggcagtgaacgacttcttgcaggtgaaaggcagcaacaacatcttcgccatcggtgacaatgcatttagcgggctgcctcctaccgcccaagtggcccaccaagaagccgagtacctggccaagaatttcgataagatggctcaaatacccaatttccaaaagaacctatcttcccggaaggataagattgacctcctgttcgaggaaaacaactttaagcccttcaaatacaacgacttaggcgccctggcctacctgggatccgaaagagccattgcaaccatcagaagcggtaagagaacattctacaccggtggaggcctgatgaccttctacttatggagaatcctgtacctgtccatgatcctgagcgccagatcgagattaaaggtctttttcgactggatcaagatggcctttttcaaaagggacttcttcaaaggcttatag

SEQ ID NO: 288 - DNA, 1542 bp, Artificial Sequence
  source: /note="Description of Artificial Sequence: Synthetic polynucleotide"
atgctgtcgaagaatctgtacagcaacaagcggctgctcaccagcaccaacaccctcgtgcgcttcgccagcaccagatccacaggcgtggaaaactccggggctggccccacctcttttaagaccatgaaagtcattgaccctcagcacagcgacaagcccaacgtgctgatcctgggttcggggtggggcgccatttcgtttctgaagcacattgacaccaagaagtacaacgtcagcatcatcagccctagaagctacttcttacacacgcccttgttacccagcgcaccagtgggaacagtggacgagaagtccattatcgagcccatcgttaatttcgccctcaagaaaaagggcaacgtcacctactatgaggccgaagccacctctatcaaccccgacaggaacaccgttaccatcaagagcttaagcgccgtgagccagctgtaccagcccgagaaccatctaggcctgcaccaggccgagcctgccgagattaagtacgactatctgatcagcgccgtgggcgcggagcccaacacatttggtattcccggcgtgaccgattacggccatttcctgaaggagattcccaacagcctggaaatcagaagaaccttcgccgccaatctggaaaaggccaacctgttgccaaagggcgaccccgaacggagaagactgctgagcattgtggtcgtgggcggtggccccacaggtgtggaagccgctggtgagctgcaggactacgttcaccaggacctgagaaagttcctgcccgcattggccgaagaagtgcagattcacctggtcgaagccctgcccatcgtgctgaacatgttcgagaaagagctgagctcatacgcgcaatcacacctggaaaacacttcgatcaaggtacatctgagaaccgccgtcgccaaagtggaagagaagcaactgctggcaaagaccaaacacgaggacggtaaaataaccgaggaaaccattccctacggcaccctgatttgggccaccggcaacaaggcaagacccgtgatcactgaccttttcaagaagatccccgagcaaaactcgtccaagagaggcttggccgtgaacgactttctgcaggtggagggcagcaacaacattttcgccatcggcgacaacgcctttgccggcctgccacctacagcccaagtagcgcaccaagaggccgagtacttggccaagaattttgataaaatggctcagatacccaatttccagaagaacctatcctcaagaaaggataagattgatctcctgttcgaggagaacaacttcaagcctttcaagtacaacgacttaggcgccttagcctacctgggctccgaaagagccattgccaccatccgtagcggcaagcggacattctacaccggcggaggcctgatgaccttctacctgtggagaatcctgtacctgagcatgatcctgtctgcccgcagcagattaaaggtcttcttcgactggatcaagctggccttcttcaaaagggacttttttaagggcttatga

SEQ ID NO: 289 - DNA, 1542 bp, Artificial Sequence
  source: /note="Description of Artificial Sequence: Synthetic polynucleotide"
atgctatcgaagaacttgtatagcaacaagcggctgctgaccagcaccaacaccatggtgagattcgcttccaccagatccacaggggtcgaaaacagcggggctggccctacaagctttaagaccatgaaagtcatcgacccccagcacagcgacaaacccaacgtgctgatactgggctctggctggggcgccatctcgtttttaaagcacattgacaccaagaagtacaacgtcagcatcatcagccctagaagctatttcctgttcacccccctgatgccttctgcccctgtggggacagtagacgagaagtccatcatcgagcccatcgtgaacttcgctctcaagaaaaaggggaacgtcacctactatgaggccgaggccaccagcatcaaccccgacaggaataccgttaccatcaagagcttaagcgccgtttcccagctataccaacctgagaaccacctagggctgcatcaggcagaacccgccgagattaagtacgattatttaatcagcgccgtgggcgccgagcccaacacctttggaatccctggcgtgactgattacggccacttcctgaaagagatccccaacagcctggaaatccggagaaccttcgccgccaatctagagaaggctaacttactgccaaagggcgaccccgagagaagaaggctgctgagcatcgtggtcgttggcggaggccctacaggtgtggaagctgctggtgagctgcaggactacgtgcaccaggacctgagaaagttcctgcccgcactggccgaagaagtgcagattcacctggtggaagccctgcccatcgtgctgaatatgttcgagaaaaagctgagctcatacgcccagtcacacctggaaaacacctcgatcaaagtacacctgagaaccgccgtggccaaggtggaagagaagcagctgctggccaagaccaaacacgaagacggcaaaattaccgaggaaactattccatacggtaccctgatttgggccaccggcaacaaggccagacccgtaatcaccgaccttttcaagaagatccccgagcagaacagcagcaagagaggactggcagtgaacgactttttgcaggtcaaaggcagcaacaacattttcgccatcggtgacaacgcctttgccggcctgcctcctacagcccaggtagcgcaccaggaagccgagtatttggccaagaacttcgacaagatggctcagatcccaaatttccaaaagaatctgtcctcaagaaaggataaaattgatctcttgttcgaggagaacaacttcaagcctttcaaatacaacgacttaggcgccctggcatacctgggaagcgaaagagccattgcaaccatccgtagcggtaagagaaccttttacaccggcggtggcctgatgaccttctacttatggagaatcttgtacatgagcatgattctaagcgcacgctcgagattaaaggtgttcttcgactggatcaaactggcattcttcaaaagagacttctttaagggcttatag

SEQ ID NO: 290 - DNA, 1542 bp, Artificial Sequence
  source: /note="Description of Artificial Sequence: Synthetic polynucleotide"
atgctgtcgaagaacctgtacagtaaccggcggctgctcacctcgaccaacaccctcgtgcgcttcgcctccaccagatccaccggcgtcgaaaactccggagctggtcccacaagcttcaagaccatgaaggtcattgacccccagcacagcgacaagcccaacgtgctgatcctgggctcgggctggggagccatctcgtttctgaagcacattgacaccaagaagtacaacgttagcatcatctctcccagaagctatttcttatttacgcctctgctgccctctgcaccagtgggaacagtagacgaaaagtcaattattgagcccatcgtgaacttcgctctgaagaaaaaggggaacgtcacctactatgaggcagaggccacctctatcaatcccgaccggaataccgttaccataaagagcctgagcgccgtgagccagctgtaccagcctgagaaccacctaggcctgcatcaggccgagcccgccgaaattaagtacgattatctgatcagtgccgtaggcgcggagcccaacacctttggaatccctggggtgaccgactacggccatttcttcaaagagatccccaactctttggaaatacggcggaccttcgccgccaatctggaaaaggccaacttactgccaaagggcgaccccgaacggagaaggctgctgtccattgtggtcgttggcggtggccccactggcgtggaagccgctggcgagctgcaggactatgttcaccaggacctgcggaagttcctccccgccctggccgaggaagtccagattcacttggtcgaagccctgcccatcgtgttgaacatgtttgagaagaagctgtcatcatacgcgcaaagccatctggaaaacacttccatcaaagtgcacctgagaacggctgtcgccaaggtggaagagaagcaattgctggcaaagaccaagcacgaggacggtaagattaccgaagaaaccatcccctacggtaccctgatttgggccaccggtaacaaggccagacccgtgatcaccgaccttttcaagaaaattcctgagcagaactcgagcaagagaggcttggccgtgaacgacttcctgcaggtcaaaggcagcaacaacatcttcgccatcggtgacaacgcctttgccggcttgccaccaacagcccaggtagcgcaccaggaggccgagtatctggccaagaacttcgacaaaatggctcagatccccaatttccagaagaacctgtcctccagaaaggataagattgatctgttgttcgaggagaacaacttcaaacctttcaaatacaacgacttaggcgccttagcctacctgggctccgaaagggccattgccaccatcagaagcggcaagcggaccttctacaccggcggtggcctgatgaccttctacttatggcggatcctgtacatgtccatgatcctgagcgcacgcagcagactgaaggtgttcttcgactggatcaagttagccttcttcaagagagacttcttcaagggattatag

SEQ ID NO: 291 - DNA, 1542 bp, Artificial Sequence
  source: /note="Description of Artificial Sequence: Synthetic polynucleotide"
atgctaagcaagaacttgtacagcaacaagaggttgctgaccagcaccaacaccctcgtgcgcttcgcctccaccagatccaccggcgtcgaaaactccggggcaggccccacaagcttcaagaccatgaaggtcatcgaccctcagcacagcgacaagcccaacgtgctgatcctgggttcggggtggggcgccatttcgtttctgaagcacatcgacaccaagaagtacaacgttagcatcatctctcctagaagctacttcttacacacccctctgttacccagcgcacctgttggaaccgtagacgaaaagtccattatcgagcccatcgtgaacttcgccctcaagaaaaagggcaacgtcacctactatgaggccgaggccaccagcatcaaccccgaccggaacaccgtgaccataaagtcattaagcgccgtgagccagctgtaccaacccgagaaccatctaggcctgcatcaagccgagcctgctgagattaagtacgactacttaatcagcgccgtaggcgcggaacctaacacctttggtatccccggcgtgactgattacggtcatttcctggaggaaatccccaacagcctggaaatcagaagaaccttcgccgccaacctggaagaggccaacctgctgcctaagggcgaccccgaacggagaagactgctgagcattgtcgtcgttggtggaggccccactggcgtggaagctgctggcgagctacaggactatgtgcaccaggacctgagaaagttcctgcccgcattggccgaggaagtccaaattcacctggtggaagctctgcccatcgtgttgaacatgtttgagaaaaagcttagctcatacgcccaatcacacttagaaaacacctcgatcaaggtgcacctgagaaccgccgtcgccaaggttgaagagaagcaactgttggccaagaccaagcacgaagacggcaagattaccgaagaaaccatcccatacggtaccttgatttgggccaccggtaacaaggccagaccggtaatcaccgacctgttcaagaagattcctgagcaaaacagcagcaagagaggcctggcagtgaatgactttttgcaggtgaaaggcagcaacaacattttcgccatcggcgacaatgcctttgctggcctgcctcctaccgcccaggtagcccaccaagaggccgagtacctggccaagaactttgacaagatggcccagatacccaatttccagaagaacctgtcttcaagaaaggataaaattgatctgttgttcgaggaaaacaactttaagcccttcaagtacaacgacctgggcgccttagcatacctgggcagcgaaagagccattgccaccatccgtagcggtaagagaaccttctacaccggcggtggcttaatgaccttctacctgtggagaatcctgtacttgagcatgatcctgagcgccagaagcagattaaaggtgttcttcgactggattaagttagcattcttcaagagggacttcttcaaaggactgtga

SEQ ID NO: 292 - DNA, 1542 bp, Artificial Sequence
  source: /note="Description of Artificial Sequence: Synthetic polynucleotide"
atgctgtcgaagaacctgtacagcaaccggcggttgctgaccagcacgaataccctcgtgagattcgctagcaccagatccaccggcgtggaaaacagcggagctggccccacaagctttaagaccatgaaggtcatcgacccccagcacagcgacaagcccaacgtgctgatactgggctcgggctggggcgctatctcgtttctgaagcacattgacaccaagaagtacaacgtcagcatcatcagccccagaagctacttcctgtttacccctctgctgcctagcgcacctgtgggaaccgtggacgagaagtcaatcattgagcccatcgtgaatttcgccctcaagaaaaaggggaacgtcacctactacgaggcagaggccacctctatcaaccccgaccggaataccgtgaccataaagagcctgtctgccgtgagccagctgtaccaacccgagaaccacctgggcctgcaccaagcagaacccgctgaaattaagtacgactatttaatcagcgctgtgggtgccgagcccaacacctttggtattcccggggtgaccgattacggtcacttcctggaggagattcccaacagcttggaaatacggcggacttttgccgccaatctagaaaaggccaacttactgcctaagggtgatcccgaaagaagaagactgctgtccatcgtggtcgttggtggtggccccacaggcgtggaagccgctggtgagctacaggactatgtgcaccaggacctgcggaagtttctccccgccctggccgaagaagtgcagattcacttggtggaagctctgcccatcgtgttgaacatgttcgagaaaaagctgagcagctacgcgcagagccatttagaaaacacttcgatcaaggtacacctgagaaccgccgtcgccaaggtggaagaaaagcagctgttggcaaagaccaaacacgaggacggcaaaataaccgaggaaactatcccctacggcactctgatttgggccaccggcaacaaggccagacccgtaatcaccgacctgttcaagaaaattcccgagcagaacagcagcaagcggggcctggccgtgaacgacttcttgcaggtgaaaggcagcaacaacatcttcgccattggcgacaatgcatttgccgggctgccacctaccgcccaggtggcgcaccaagaagccgaatacttggccaagaatttcgataaaatggcccaaatccccaatttccaaaagaacctgtcttcccggaaggataagattgatctgctgttcgaggaaaacaactttaagcccttcaagtacaacgacctgggcgccttagcctacctgggaagcgaaagagccattgcaaccataagaagcggtaagcggacattttacaccggtggaggcttaatgaccttctacctgtggagaatcctgtacttgtccatgatcctgagcgcacgcagcagattaaaggtgttcttcgactggatcaagatggcattcttcaaaagggacttcttcaagggcttatga

SEQ ID NO: 293 - DNA, 1542 bp, Artificial Sequence
  source: /note="Description of Artificial Sequence: Synthetic polynucleotide"
atgctatcgaagaacttgtacagcaacaagcggttgctcacctcgaccaacacgctcgtgagattcgctagcaccagatccaccggggtggaaaactccggggcaggtcccaccagcttcaagaccatgaaggtcatcgacccccagcacagcgacaagccaaacgtgctgatactgggctctggctggggagctatcagctttctgaagcacattgacaccaagaagtacaacgtctccatcatcagccctagaagctatttcttattcacccccctgttacccagcgcccctgttggaacagtagacgagaagtccatcattgagcccatcgtgaacttcgccctgaagaaaaagggcaacgtcacctactatgaggcagaggccacctctatcaaccccgacaggaacaccgtgaccataaagagcttatctgccgtttcccagctataccaacccgagaaccacctgggcctgcatcaagccgaacccgctgagattaagtacgactatctgatcagtgccgtgggtgccgagcccaacacatttggaattcccggcgtcaccgactacggtcatttcctgaaagaaatccccaactctctggaaatacggagaacctttgccgccaacctagaagaggccaacttactgccaaagggcgaccccgagagaagaagactactgagcatcgtggtggttggcggtgggcccacaggcgtggaggccgctggcgaactacaggactacgttcaccaggacctgagaaagtttttccccgccctggccgaagaagtgcaaattcacttggtcgaagctctgcccatcgtgttgaatatgttcgagaagaagcttagcagctacgcccaatcacacctggaaaacacctccatcaaagtgcacctgagaaccgccgtcgccaaggtggaagagaagcagctgctggccaagaccaagcacgaggacggtaagataaccgaggaaactatcccctacggcaccctgatttgggccacgggcaacaaggcaagaccggtgatcactgacctgttcaagaagatccccgagcagaacagcagcaagagaggattggcagtgaatgacttcttgcaggtcaaaggcagcaacaacatcttcgccatcggcgacaacgcctttgccgggctgcctcctaccgcccaggtggcgcaccaagaggccgaatatctggccaagaactttgacaagatggctcagataccaaatttccagaagaatctgtcttcccggaaggataagatcgatctgctgttcgaggaaaacaacttcaagcccttcaaatacaacgacttaggcgccctggcatacctgggaagcgaaagagccattgccaccataagatccggcaagcggaccttctacaccggcggaggcctgatgaccttctacctgtggcggatcctgtacttgagcatgattctatctgcaagatcgagactgaaggtgttcttcgactggatcaaactggcctttttcaagagggacttcttcgagggactgtag

SEQ ID NO: 294 - DNA, 1542 bp, Artificial Sequence
  source: /note="Description of Artificial Sequence: Synthetic polynucleotide"
atgctaagcaagaatctgtacagcaacaagaggctgctcacctcgaccaacacgctagtgcgcttcgctagcaccagatccacaggggtcgaaaactccggggcaggccccacatctttcaagaccatgaaggtcatcgacccccagcacagcgacaaaccaaacgtgctgatactgggctcgggctggggagccatcagctttctgaagcacatcgacaccaagaagtacaacgtcagcatcatctctcccagaagctacttcctgttcacccccctgctgcctagcgcaccagttggaaccgtagacgaaaagtccattatcgagcccatcgtgaactttgctctgaagaaaaaggggaacgtcacctactacgaggccgaggccaccagcatcaaccccgaccggaacaccgtgaccatcaaaaacttaagcgccgtgtcccagctgtaccaacctgagaaccacctagggctgcaccaggccgagcctgccgagattaagtacgactatttaatcagtgccgtgggtgccgaacccaacacatttggtatccctggcgtcactgactacggccacttcctgaaagagatccccaacagcttggaaatacggcggacttttgccgccaacctggagaaggctaacctgctgcctaagggcgatcccgaacggagaaggctgctgtccatcgtcgtggtgggcggagggcccacaggcgtagaggccgctggtgaactacaggactatgttcaccaggacctgcggaagtttctgcctgcactggccgaagaagtccagattcacctggtcgaagccctgcccatcgttttgaacatgtttgagaaagagctgagctcatacgcccagagccacctggaaaacacctccatcaaggtgcacctgagaaccgctgtcgccaaggttgaagaaaagcaattgctggcaaagaccaaacacgaggacggcaagataaccgaagaaaccatcccctacggtaccttgatttgggccaccggcaacaaggccagacccgtgatcaccgacctgttcaagaaaatccccgagcagaacagctccaagcggggcctggccgtgaacgacttcctgcaggtgaaaggcagcaacaacatcttcgccattggtgacaatgcatttgccggcttgccaccaaccgcccaggtggcgcaccaggaagccgagtacttggccaagaatttcgacaaaatggcccagatccccaatttccagaagaatctgtcctcccggaaggataagattgatctcttgttcgaggaaaacaactttaagcctttcaagtacaacgacctgggtgccctggcctacctgggcagcgaaagggccattgccaccatccgtagcggcaagcggacattttacaccggcggaggcctgatgaccttctacctgtggcagatcctgtacctgtccatgatcctatctgcccgcagcagactgaaggtgtttttcgactggatcaagctggcctttttcaaaagagacttttttaagggcctgtag

SEQ ID NO: 295 - DNA, 1542 bp, Artificial Sequence
  source: /note="Description of Artificial Sequence: Synthetic polynucleotide"
atgctaagcaagaatctgtacagtaacaagcggctgctcaccagcacgaacaccctcgtccgcttcgctagcaccagatccacaggcgtggaaaacagcggagcaggccctacaagcttcaagaccatgaaggtcatcgacccccagcacagcgacaagcccaacgtgctgatactgggctctggctggggcgccatctcgtttctgaagcacatcgacaccaagaagtacaacgtcagcatcatcagccccagaagctatttcctgtttacccccttgatgcccagcgcaccagtggggacagtggacgaaaagtccatcatcgagcccatcgtgaacttcgctctcaagaaaaagggcaacgttacctactacgaggcagaagccaccagcatcaaccccgacaggaataccgtgaccatcaaaaacctgtctgccgtgtcccagctataccagcccgaaaaccacctggggctgcaccaagccgaacctgccgagattaagtacgactatttaatcagtgccgtgggcgcggaacccaacacatttggtattcccggcgtcaccgactacggccacttcctgaaagaaatccccaactctctggaaatccggagaacctttgccgccaatctagaaaaggctaacttactgcctaagggcgaccccgagcggagaaggctgctgagcattgtggtcgtgggcggtgggcctactggcgtggaagctgctggtgaactgcaggactacgtgcaccaggacctgagaaagttcctgcccgccctggccgaggaagtgcaaattcacctggtggaagccctgcccatcgttctgaacatgttcgagaaaaagctgagcagctacgcccaatcacacctggaaaacacttccatcaaggtgcacctgagaacggctgtcgccaaagtggaagagaagcagctgttggccaagaccaaacacgaagacggtaaaataaccgaagaaactatcccctacggtactctgatttgggccacgggtaacaaggcaagaccggtgatcaccgacctgttcaagaagattcccgagcaaaactcgagcaagcggggactggcagtgaatgacttcctgcaggtcaaaggcagcaacaacatcttcgccatcggtgacaatgcatttgccgggttgccacctacagcccaagtggcgcaccaggaggccgaatatttggccaagaacttcgataagatggcccagatccccaatttccaaaagaacctatcctcccggaaggataagattgacctgctgttcgaggaaaacaacttcaagcccttcaagtacaacgatctgggcgccttagcctacctgggctccgaaagagccattgccaccatacgttccggcaagcggacattttacaccggtggaggcttaatgaccttctacctgtggagaatcctgtacatgagcatgattctgtctgcacgctcgagactgaaggtcttcttcgactggattaagttagccttcttcaaaagggacttcttcaagggcctgtga

SEQ ID NO: 296 - DNA, 1542 bp, Artificial Sequence
  source: /note="Description of Artificial Sequence: Synthetic polynucleotide"
atgctgagcaagaacctgtatagtaacaagcggctgctgacctcgaccaacaccctagtgagattcgctagcaccagatccaccggggtggaaaacagcggggctggccctacctcttttaagaccatgaaggtcattgacccccagcacagcgacaagcccaacgtgctgatactgggttctggctggggcgccattagctttctgaagcacattgacaccaagaagtacaacgttagcatcatctctcccagaaagtatttcctgttcacgcctttgatgcctagcgcccctgttggaacagtggacgagaagtccatcatcgagcccatcgtgaatttcgctctgaagaaaaagggcaacgtcacctactacgaggcagaggccaccagcatcaatcccgaccggaataccgttaccataaagagcttaagcgccgttagccagctataccagcccgagaaccatctaggcctgcaccaggcagaacccgccgagattaagtacgattacctgatcagcgccgtgggtgcggagcccaacacatttggtatccccggcgtgactgactacggccacttcctgaaggagatccccaacagcctggaaatacggcggacttttgccgccaatctggaaaaggccaacctgctgccaaagggcgaccccgagagaagaagactgctgtccatcgtcgtggttggcggtggccctacaggcgtggaagccgctggcgagctgcaggattacgtgcaccaggacctgagaaagtttctgcccgccttggccgaagaagtgcagattcacctggtggaagccctgcccatcgttctgaacatgttcgagaagaagctgtcaagctacgcccagagccatctggaaaacacctcgatcaaggtacacctgagaaccgctgtggccaaggtggaagaaaagcaattgctggcaaagaccaaacacgaggacggcaagattaccgaagaaactattccatacggtactctgatttgggccacgggcaacaaggcaagaccggtgatcaccgacctgttcaagaagattcctgagcaaaacagcagcaagcggggcttggccgtgaacgacttcctgcaggtcaaaggcagcaacaacattttcgccattggcgacaacgcctttgccgggttgcctcctaccgcccaggtagcccaccaagaagccgaatacatcgccaagaattttgacaagatggctcaaatccccaatttccaaaagaacctatcttccagaaaggataagatcgatctgctgttcgaggagaacaacttcaagcccttcaaatacaacgatctgggtgccctggcatacctgggcagcgaaagagccattgccaccatcagatccggtaagcggacattttacaccggtggaggcttaatgaccttctacctgtggcggattttgtacctgagcatgatcctaagcgcccgcagcagactgaaggtcttcttcgactggatcaagttagccttcttcaaaagagacttttttaagggcttatga

SEQ ID NO: 297 - DNA, 1542 bp, Artificial Sequence
  source: /note="Description of Artificial Sequence: Synthetic polynucleotide"
atgctgagcaagaacctgtacagcaacaagaggctgctgaccagcaccaacaccctcgtgagattcgccagcaccagatccaccggggtggaaaacagcggagcaggccctacatctttcaagaccatgaaagtcatcgacccccagcacagcgacaagcccaacgtgctgatactgggctctggctggggagctattagctttttaaagcacattgacaccaagaagtacaacgttagcatcatcagccctagaagctatttcttatttacccctttgctgcccagcgcccctgtgggaacagtggacgaaaagtcaattattgagcccatcgtgaatttcgctctgaagaaaaaggggaacgtcacctactacgaggccgaggccaccagcatcaaccccgaccggaataccgtgaccatcaagagcctgagcgccgtgtcccagctataccagcctgagaaccacctgggcctgcatcaagccgagcctgctgagattaagtacgactatctgatcagcgccgtaggtgccgagcccaacacctttggtatccctggcgtgactgactacggccacttcctgaaggaaatccccaacagcctggaaatccggcggacctttgccgccaacctggaagaggccaacctgttgccaaagggtgaccccgaacggagaaggctgctgagcattgtcgtggtgggcggaggccctacaggcgtggaagctgctggcgagctacaggattatgtgcaccaggacctgagaaagtttctccctgccctggccgaagaagtccagattcacttggtggaagccctgcccatcgttctgaacatgttcgagaaagagctttcaagctacgcgcaaagccacttagaaaacacctccatcaaagtacatctgagaaccgccgtcgccaaagttgaagagaagcaactgttggccaagaccaagcacgaagacggcaagattaccgaggaaaccatcccctacggtactctgatttgggccaccggtaacaaggccagaccggtaatcaccgacctgttcaagaagattcctgagcagaacagcagcaagagaggactggcagtgaacgactttttgcaggtgaaaggcagcaacaacattttcgccatcggtgacaacgcctttgccgggttgccacctacagcccaggtggcccaccaagaagccgaatatctggccaagaattttgacaaaatggctcagatcccaaatttccagaagaacctgtcctcaagaaaggataagattgatctcttgttcgaggaaaacaacttcaagcccttcaagtacaacgatttaggtgccctggcctacctgggctccgaaagagccattgcaaccatccgttccggcaagagaacattttacaccggtggaggcctgatgaccttctacctgtggcggattctgtacctgagcatgatcctgagcgcccgcagcagactgaaggtgttcttcgactggattaagctggcctttttcaagagagacttcttcgagggcctgtga

SEQ ID NO: 298 - DNA, 1542 bp, Artificial Sequence
  source: /note="Description of Artificial Sequence: Synthetic polynucleotide"
atgctaagcaagaatttgtatagcaacaagcggttgctgaccagcacgaatacgctcgtgagattcgccagcaccagatccaccggcgtggaaaacagcggagctggccccacaagcttcaagaccatgaaagtcattgaccctcagcacagcgacaagccaaacgtgctgatactgggttcggggtggggcgccatttcgtttctgaagcacattgacaccaagaagtacaacgtttccatcatctctcccagaaagtacttcctgttcacgcccctgttaccctctgcacctgttggaaccgtggacgaaaagtccatcatcgagcccatcgtgaacttcgctctcaagaaaaaggggaacgtcacctactacgaggccgaggccaccagcatcaaccccgaccggaataccgttaccatcaaaagcctgagcgccgtgagccagctataccagcccgaaaaccacctggggctgcatcaggccgagcccgccgagattaagtacgattacctgatcagcgccgtaggcgccgagcccaacacatttggtatccctggcgtcaccgattacggccacttcctggaggagatccccaactctctggaaataagacggactttcgccgccaacctggaaaaggctaacttactgccaaagggcgatcccgagcggagaaggctactgtccattgtcgtcgttggtggagggcccactggcgtagaggctgctggtgaactgcaggattatgtgcaccaggacctgcggaagtttctgcccgccctggccgaggaagtgcagattcacctggtggaagccctgcccatcgtgctgaatatgtttgagaaggagctgagcagctacgcccagagccacctggaaaacacctccatcaaggtgcatctgagaacggccgtcgccaaggttgaagagaagcaactgttggccaagaccaagcacgaggacggcaagattaccgaagaaactatcccctacggcactttgatttgggccacgggcaacaaggccagaccggtgatcaccgaccttttcaagaagatccccgagcaaaacagcagcaagcggggattggccgtgaatgacttcttgcaggtgaaaggcagcaacaacatcttcgccatcggtgacaacgcctttgccggcctgcctccaacagcccaagtggcgcaccaggaagccgagtacctggccaagaactttgacaaaatggctcagatcccaaatttccaaaagaatctgtcttcaagaaaggataaaatcgacctcctgttcgaggagaacaacttcaagcctttcaagtacaacgacctgggcgccctggcctacctgggatccgaaagagccattgccaccatccgttccggtaagcggacattctacaccggcggaggcttaatgaccttctacctgtggcggatcttgtacctgtccatgatcctgtctgcccgctcgagattaaaggtctttttcgactggatcaagctggccttcttcaagagagacttttttaaaggcctgtga

SEQ ID NO: 299 - DNA, 1542 bp, Artificial Sequence
  source: /note="Description of Artificial Sequence: Synthetic polynucleotide"
atgctgagcaagaacctgtacagcaacaagaggctgctcaccagcaccaacaccatggtccgcttcgcctccaccagatccaccggggtggaaaacagcggggctggccccacctctttcaagaccatgaaggtcatcgacccccagcacagcgacaagcccaacgtgctgatactgggttctggctggggagccattagctttctgaagcacatcgacaccaagaagtacaacgtttccatcatcagccccagaagctatttcctgttcacccctctgttacccagcgcaccagttggaacagtggacgagaagtccattatcgagcccatcgttaatttcgccctgaagaaaaaggggaacgttacctactacgaggccgaggccaccagcatcaatcccgaccggaacaccgtgaccatcaaaagcttatctgccgtgagccagctgtaccagcctgaaaaccacctgggcctgcatcaggcagagcctgctgagattaagtacgattacctgatcagtgccgtgggtgccgagcctaacacctttggtatccccggggtcactgactacggccacttcctgaaggagatccccaacagcttggaaatcagacggacctttgccgccaacctagaaaaggccaacctgctgccaaagggtgatcccgaacggagaagactgctgtccattgtggtggttggcggagggcctactggtgtagaagccgctggcgaactgcaggactacgttcaccaggacctgcggaagttcctgcctgccctggccgaagaagtccaaattcacttggtcgaagccctgcccatcgttttgaacatgttcgagaagaagctgagcagctacgcccaaagccacctggaaaacacctcgatcaaggtgcacctgagaaccgccgtcgccaaagtggaagagaagcagttgctggcaaagaccaaacacgaggacggcaaaataaccgaggaaaccattccctacggcaccctgatttgggccacgggcaacaaggccagaccggtgatcactgaccttttcaagaaaattcctgagcagaacagctccaagagaggcttggcagtgaatgacttcctgcaggtcaaaggcagcaacaacatcttcgccattggtgacaacgcctttgccgggctgcctcctacagcccaagtggcccaccaagaagccgaatatatcgccaagaatttcgacaagatggctcagatacccaatttccaaaagaacctatcctccagaaaggataagatcgatctcctgttcgaggaaaacaacttcaaacctttcaagtacaacgacttaggcgccctggcctacctgggcagcgaaagagccattgcaaccataagaagcggcaagcggacattctacaccggcggaggcctgatgaccttctacttatggcggattctgtacctgagcatgatcctatctgcacgctcgagactgaaggtcttcttcgactggatcaaactggccttcttcaaaagggacttctttgagggcctgtga

SEQ ID NO: 300 - DNA, 1542 bp, Artificial Sequence
  source: /note="Description of Artificial Sequence: Synthetic polynucleotide"
atgctgtcgaagaatctgtatagtaacaagaggttgctgaccagcacgaacacgctagtccgcttcgctagcaccagatccaccggggtcgaaaacagcggggctggccccaccagcttcaagaccatgaaggtcatcgaccctcagcacagcgacaagcccaacgtgctgatcctgggctctgggtggggcgccatctcgtttttaaagcacattgacaccaagaagtacaacgttagcatcatctctcccagaagctacttcctgttcacgcccttgttacccagcgcccctgtggggacagtggacgaaaagtccatcatcgagcccatcgttaattttgccctcaagaaaaaggggaacgtcacctactacgaggccgaagccacctctatcaatcccgaccggaacaccgtgaccataaagaacctgagcgccgtttcccagctgtaccaacccgagaaccatctggggctgcaccaggccgagcccgccgaaattaagtacgattacctgatcagtgccgtaggcgcggaacccaacacctttggtattcctggcgtcaccgactacggtcatttcttcaaggaaattcccaactctctggaaatccggcggaccttcgccgccaacctagaaaaggccaacctgctgccaaagggtgaccccgagcggagaaggctgctgagcatcgtcgtcgtgggcggtggccccactggcgtagaagccgctggtgagctgcaggactacgttcaccaggacctgcggaagttcctgcccgcattggccgaggaagtgcaaattcacctggtggaagctctgcccatcgttctgaacatgttcgagaagaagctttcaagctacgcgcagagccacttagaaaacacttcgatcaaagtgcacctgagaacggctgtggccaaggtggaagaaaagcaattgctggccaagaccaagcacgaggacggcaaaattaccgaagaaaccatcccatacggtactctgatttgggccaccggcaacaaggccagacccgtgatcactgacctgttcaagaaaatccccgagcagaactcgagcaagcggggcttggccgtgaacgactttttgcaggtcaaaggcagcaacaacatcttcgccatcggtgacaacgcctttagcggcctgcctccaaccgcccaggtggcgcaccaagaggccgaatatctggccaagaactttgacaagatggctcagatacccaatttccagaagaacctgtcttcacggaaggataagattgacctcttgttcgaggaaaacaacttcaagcctttcaagtacaacgatttaggtgccctggcctacctgggctccgaaagagccattgcaaccatccgtagcggtaagcggaccttctacaccggtggaggcttaatgaccttctacttatggcggatcctgtacttgagcatgattctgagcgcaagatcgagactgaaggtcttcttcgactggatcaaactggcattcttcaagagagactttttcaagggcctgtga

SEQ ID NO: 301 - DNA, 1542 bp, Artificial Sequence
  source: /note="Description of Artificial Sequence: Synthetic polynucleotide"
atgctgagcaagaatctgtacagtaacaagcggctgctcaccagcacgaacacgctagtgagattcgccagcaccagatccaccggggtcgaaaacagcggggctggtcccacaagcttcaagaccatgaaggtcattgacccccagcacagcgacaagcccaacgtgctgatcctgggctcggggtggggcgccatcagctttttaaagcacatcgacaccaagaagtacaacgtcagcatcatcagccctagaaagtacttcctgttcacccccctgctgccctctgcccctgttgggaccgtggacgaaaagtcaatcatcgagcccatcgtgaatttcgctctcaagaaaaagggcaacgttacctactacgaggccgaagccacctctatcaaccccgaccggaataccgttaccataaagagcttatctgccgtttcccagctataccagcccgagaaccatctagggctgcaccaagccgaacccgccgaaattaagtacgactacttaatcagcgccgtaggtgccgagcccaacacatttggaatccccggcgtgaccgattacggccacttcctgaaagagatccccaactctctggaaatccggcggactttcgccgccaacctggaaaaggctaacctgctgcctaagggcgatcccgagcggagaagactactgtccattgtggtggtgggcggaggccccactggtgtggaggccgctggtgagctgcaggactacgttcaccaggacctgcggaagttcctgcccgcactggccgaggaagtgcaaattcacctggtggaagccctgcccatcgttttgaatatgtttgagaagaagctttcaagctacgcgcaaagccatctggaaaacacttcgatcaaagtacacctgagaaccgccgtggccaaggttgaagaaaagcaattgctggcaaagaccaaacacgaagacggcaagattaccgaagaaactatcccatacggtactttgatttgggccacgggcaacaaggcaagacccgtgatcaccgacctgttcaagaagatccctgagcagaacagcagcaagcggggcctggccgtgaacgacttcctgcaggtgaaaggcagcaacaacattttcgccatcggcgacaatgcatttgctggcctgcctcctacagcccaggtagcgcaccaggaagccgaatacctggccaagaattttgacaaaatggcccaaataccaaatttccaaaagaatctgtcttcccggaaggataaaatcgatctgctgttcgaggaaaacaactttaagcctttcaagtacaacgatctgggtgccctggcctacctgggcagcgaaagagccattgccaccatcagatccggcaagagaaccttctacaccggcggtggcctgatgaccttctacctgtggagaattttgtacatgagcatgattctaagcgcaagatcgagactgaaggtgtttttcgactggatcaagatggcatttttcaagagagacttcttcaagggcctgtga

SEQ ID NO: 302 - DNA, 1542 bp, Artificial Sequence
  source: /note="Description of Artificial Sequence: Synthetic polynucleotide"
atgctaagcaagaatctgtatagcaacaagcggttgctgaccagcacgaacacgatggtgcgcttcgcttccaccagatccacaggcgtcgaaaactccggggcaggtcccacaagcttcaagaccatgaaagtcattgacccccagcacagcgacaagccaaacgtgctgatactgggctctgggtggggagccatcagctttctgaagcacattgacaccaagaagtacaacgtctccatcatcagccccagaagctacttcttattcacccctctgatgcctagcgcccctgtgggaaccgtggacgagaagtcaatcatcgagcccatcgttaatttcgctctcaagaaaaagggcaacgtcacctactacgaggccgaagccacctctatcaaccccgaccggaacaccgtgaccatcaaaagcttatctgccgtgtcccagctataccagcccgagaaccacctgggcctgcaccaggccgaacccgccgagattaagtacgactatttaatcagcgccgtaggtgcggagcctaacacatttggtatccccggggtgaccgactacggtcacttcctgaaagaaattcccaactctttggaaatcagacggacctttgccgccaacctggaaaaggccaacttactgccaaagggcgaccccgagcggagaaggctactgagcattgtggtggtgggcggaggccctactggcgtagaggccgctggcgagctgcaggactatgtgcaccaggacctgagaaagtttctccctgccctggccgaggaagtgcagattcacctggtcgaagccctgcccatcgttctgaacatgtttgagaaggagctgtcatcatacgcccagtcacacctggaaaacacctccatcaaagtgcacctgagaaccgccgtcgccaaggttgaagaaaagcaattgttggccaagaccaaacacgaagacggtaaaataaccgaggaaactatcccctacggtaccttgatttgggccacgggtaacaaggcaagaccggtgatcaccgaccttttcaagaagattcccgagcagaacagctccaagcggggcttggccgtgaatgactttctgcaggtgaaaggcagcaacaacattttcgccatcggcgacaatgcctttgctgggttgcctcctacagcccaggtggcccaccaggaagccgagtacctggccaagaatttcgacaagatggctcaaatccccaatttccagaagaacctgtcctccagaaaggataagatcgacctgctgttcgaggaaaacaactttaagcccttcaagtacaacgatttaggcgccctggcatacctgggctccgaaagggccattgccaccatacgtagcggcaagcggacattctacaccggcggtggcctgatgaccttctacctgtggagaattctgtacctgtccatgatcctgtctgcccgctcgagattaaaggtgtttttcgactggatcaagctggccttcttcaagagggacttttttaagggcttatga

SEQ ID NO: 303 - DNA, 1542 bp, Artificial Sequence
  source: /note="Description of Artificial Sequence: Synthetic polynucleotide"
atgctaagcaagaacctgtatagtaacaagaggctgctgacctcgacgaacaccctcgtgcgcttcgcctccaccagatccaccggcgtcgaaaactccggagctggccccaccagcttcaagaccatgaaggtcatcgacccccagcacagcgacaaacccaacgtgctgatcctgggctcgggctggggcgctatcagctttttaaagcacattgacaccaagaagtacaacgttagcatcatcagccctagaaagtacttcctgtttacgcctctgctgccttctgcccctgttgggacagtggacgagaagtcaattattgagcccatcgttaactttgctctgaagaaaaaggggaacgtcacctactacgaggccgaagccaccagcatcaaccccgacaggaataccgttaccataaagagcctgagcgccgtgagccagctgtaccaacctgagaaccacctaggcatgcatcaagcagagcccgccgagattaagtacgactacctgatcagtgctgtgggtgccgaacccaacacctttggtatccccggcgtgactgactacggtcacttcctgaaggaaattcccaactctctggaaatcagaagaacctttgccgccaatctagaaaaggccaacctgttgcctaagggtgatcccgagcggagaagactactgagcattgtggtcgttggcggaggccctactggcgtagaagccgctggcgaactacaggactatgtgcaccaggacctgcggaagttcttccccgccctggccgaggaagtgcagattcacttggtggaagctctgcccatcgttttgaacatgtttgagaagaagcttagcagctacgcgcagagccacctggaaaacacctccatcaaagtgcacctgagaacggctgtggccaaggtggaagagaagcaactgctggccaagaccaaacacgaagacggcaagattaccgaggaaaccatcccctacggcactctgatttgggccaccggcaacaaggcaagaccggtgatcaccgaccttttcaagaaaatccccgagcaaaactcgagcaagcggggcttggcagtgaacgactttctgcaggtcaaaggcagcaacaacatcttcgccatcggcgacaacgcctttgctggcctgcctcctaccgcccaggtagcgcaccaggaggccgagtacttggccaagaactttgataagatggctcaaatacccaatttccagaagaatctatcctcccggaaggataaaatcgacctgctgttcgaggagaacaacttcaagcctttcaaatacaacgatctgggcgccctggcctacctgggctccgaaagggccattgcaaccatcagatccggcaagcggaccttttacaccggtggaggcctgatgaccttctacctgtggcggattctgtacctgagcatgattctgagcgcaagaagcagattaaaggtgttcttcgactggattaagctggcctttttcaagagggacttcttcaagggcttatga

SEQ ID NO: 304 - DNA, 1542 bp, Artificial Sequence
  source: /note="Description of Artificial Sequence: Synthetic polynucleotide"
atgctgagcaagaacctgtacagcaacaagcggctgctgaccagcacgaacaccctcgtgcgcttcgccagcaccagatccaccggcgtcgaaaacagcggggctggccccaccagctttaagaccatgaaggtcatcgacccccagcacagcgacaagcccaacgtgctgatactgggctctgggtggggcgctatcagctttctgaagcacatcgacaccaagaagtacaacgtcagcatcatcagccccagaagctacttcctgttcacccccctgctgcccagcgccccagtggggaccgtggacgagaagtccatcatcgagcccatcgtgaattttgccctgaagaaaaagggcaacgtcacctactacgaggccgaggccaccagcatcaaccccgaccggaacaccgtgaccatcaaaagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgttgcctaagggcgaccccgagcggagaaggctgctgagcatcgtcgtcgtgggcggaggccccacaggcgtggaagctgctggcgagctgcaggactacgtgcaccaggacctgcggaagttcctgcctgccctggccgaggaagtgcagattcacctggtggaagccctgcccatcgttttgaacatgttcgagaaggagctgagcagctacgcccagagccacctggaaaacacctcgatcaaggtacacctgagaacggccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaaaattcccgagcagaacagcagcaagcggggcctggccgtgaacgacttcctgcaggtgaaaggcagcaacaacatcttcgccatcggcgacaacgcctttgctggcctgcctcctacagcccaggtggcgcaccaggaagccgagtacatcgccaagaacttcgacaagatggcccaaatccccaatttccagaagaacctgtcctcccggaaggataagatcgacctgctgttcgaggaaaacaacttcaagcctttcaagtacaacgacctgggcgccctggcctacctgggcagcgaaagagccattgccaccatcagaagcggcaagcggaccttctacaccggcggaggcctgatgaccttctacctgtggcggatcctgtacctgtccatgatcctgagcgcccgcagcagactgaaggtcttcttcgactggatcaagctggccttcttcaagagagacttctttaagggcctgtga

SEQ ID NO: 305 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaagtcattgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaactttgccctgaagaaaaagggcaacgtcacctactacgaggccgaggccaccagcatcaaccccgaccggaacaccgtgaccatcaaaagcctgagcgccgtgagccagctataccagcctgagaaccacctgggcatgcaccaggcagagcccgccgagattaagtacgactacctgatcagcgctgtgggcgccgaacccaacacctttggaatccctggcgtgaccgactacggccacttcttcaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccaaagccacctggaaaacacctccatcaaggtgcacctgagaacggccgtggccaaagtggaagagaagcagctgttggccaagaccaagcacgaggacggcaagattaccgaggaaactatcccctacggcaccctgatttgggccaccggcaacaaggccagacccgtgatcaccgacctgttcaagaagatccccgagcaaaacagcagcaagcggggcctggccgtgaatgacttcctgcaggtgaaaggcagcaacaacatcttcgccatcggcgacaacgcctttgccgggctgcctcctacagcccaggtagcccaccaggaagccgagtacctggccaagaacttcgacaagatggcccagatccccaatttccagaagaatctgtcctcccggaaggataagatcgacctgctgttcgaggaaaacaacttcaaacccttcaagtacaacgacctgggcgccctggcctacctgggcagcgaaagagccattgccaccataagaagcggcaagcggaccttctacaccggtggaggcctgatgaccttctacctgtggcggatcctgtacctgagcatgatcctaagcgcccgctcgagactgaaggtgttcttcgactggatcaaactggccttcttcaagagggactttttcaagggcctgtga

SEQ ID NO: 306 - DNA, 1542 bp, Artificial Sequence
  source: /note="Description of Artificial Sequence: Synthetic polynucleotide"
atgctgagcaagaacctgtacagcaacaagcggttgctcacctcgaccaacaccctagtgcgcttcgccagcaccagatccaccggcgtcgaaaacagcggggctggccccaccagcttcaagaccatgaaggtcatcgacccccagcacagcgacaagccaaacgtgctgatcctgggctctggctggggcgccatctcgtttttaaagcacatcgacaccaagaagtacaacgtcagcatcatcagccccagaaagtacttcctgttcacccccctgctgcccagcgcccctgtgggaaccgtggacgagaagtccatcatcgagcccatcgtgaactttgccctcaagaaaaagggcaacgtcacctactacgaggccgaggccaccagcatcaaccccgaccggaacaccgtgaccatcaagagcctgagcgccgtgtcccagctgtaccagcccgagaaccacctggggctgcaccaggccgagcccgccgagattaagtacgactacctgatcagcgccgtgggcgccgaacccaacacctttggtatccccggcgtgaccgactacggccacttcctgaaagagatccccaacagcttggaaatccggcggaccttcgccgccaacctggaaaaggccaacctgctgcctaagggcgaccccgagcggagaaggctgctgagcatcgtggtcgtgggcggaggccccactggcgtggaagctgctggcgagctgcaggactacgtgcaccaggacctgcggaagttcttccccgccctggccgaggaagtgcagattcacctggtggaagccctgcccatcgttctgaacatgttcgagaagaagctgagcagctacgcccagagccacttagaaaacacctccatcaaggtgcacctgagaaccgccgtggccaaagtggaagagaagcagctgctggccaagaccaagcacgaagacggcaagattaccgaggaaaccatcccctacggcaccctgatttgggccaccggcaacaaggccagacccgtgatcaccgacctgttcaagaagatccccgagcagaacagcagcaagcggggcttggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatcccaaatttccagaagaacctgtcctccagaaaggataagattgacctgctgttcgaggaaaacaacttcaagcccttcaagtacaacgacctgggcgccctggcctacctgggaagcgaaagagccattgcaaccatcagatccggcaagcggaccttctacaccggcggaggcctgatgaccttctacttatggcggatcctgtacctgagcatgattctgagcgcccgcagcagactgaaggtgttcttcgactggatcaagatggccttcttcaagagggacttcttcaaaggactgtga

SEQ ID NO: 307 - DNA, 1542 bp, Artificial Sequence
  source: /note="Description of Artificial Sequence: Synthetic polynucleotide"
atgctgagcaagaacctgtacagcaacaagaggctgctgaccagcaccaacaccctcgtgcgcttcgccagcaccagatccaccggcgtcgaaaacagcggggctggccccacaagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacgcccctgttacccagcgcccctgtgggaaccgtagacgagaagtcaatcatcgagcccatcgtgaacttcgccctcaagaaaaagggcaacgtcacctactacgaggccgaggccaccagcatcaaccccgaccggaacaccgtgaccatcaagagcctgagcgccgtgtcccagctgtaccaacccgagaaccacctgggcctgcaccaagccgagcccgccgagattaagtacgactacctgatcagcgccgtgggcgccgagcccaacacctttggaatccccggcgtgactgactacggccacttcctgaaagagatccccaacagcctggaaatcagacggactttcgccgccaacctggaagaggccaacctgctgcctaagggcgaccccgaacggagaaggctgctgagcatcgtggtcgtgggcggagggcccacaggcgtggaggctgctggcgagctgcaggactacgtgcaccaggacctgcggaagttcctgcccgccctggccgaggaagtgcaaattcacctggtggaagccctgcccatcgtgctgaacatgtttgagaaggagctgagcagctacgcccagagccacctggaaaacacctccatcaaagtgcacctgagaaccgccgtggccaaggtggaagagaagcagctgctggccaagaccaagcacgaagacggcaagattaccgaggaaaccatcccatacggtaccctgatttgggccaccggcaacaaggccagacccgtaatcaccgacctgttcaagaagatccctgagcagaacagcagcaagcggggcctggcagtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaatctgtcctccagaaaggataagatcgacctgctgttcgaggaaaacaacttcaagcccttcaagtacaacgacctgggtgccctggcctacctgggcagcgaaagagccattgccaccatcagatccggcaagcggaccttctacaccggcggaggcctgatgaccttctacctgtggcggatcctgtacttgagcatgatcctgagcgcccgcagcagactgaaggtgttcttcgactggatcaagctggccttcttcaagagggacttcttcaagggcctgtga

SEQ ID NO: 308 - DNA, 1542 bp, Artificial Sequence
  source: /note="Description of Artificial Sequence: Synthetic polynucleotide"
atgctgagcaagaacttgtacagcaacaagcggctgctgaccagcaccaacaccctcgtgcgcttcgccagcaccagatccaccggcgtcgaaaacagcggggctggccccaccagctttaagaccatgaaggtcatcgacccccagcacagcgacaagcccaacgtgctgatcctgggctctggctggggcgccatcagctttctgaagcacatcgacaccaagaagtacaacgtctccatcatctctcccagaagctacttcctgcacacccccctgctgcccagcgcccctgtgggaaccgtggacgagaagtccatcatcgagcccatcgtgaacttcgctctgaagaaaaagggcaacgtcacctactacgaggccgaggccaccagcatcaaccccgacaggaataccgtgaccatcaagagcctgagcgccgtgtcccagctgtaccaacccgagaaccacctagggctgcaccaggccgagcccgccgagattaagtacgactacttaatcagcgccgtgggcgccgagcccaacacctttggaatccccggcgtgaccgactacggccacttcctgaaagagatccccaacagcctggaaatacggcggaccttcgccgccaatctggaaaaggccaacctgctgcctaagggcgaccccgagcggagaaggctgctgagcatcgtggtcgtgggtggaggccccacaggcgtggaagctgctggcgagctgcaggactacgtgcaccaggacctgcggaagttcctgcccgccctggccgaggaagtgcagattcacctggtggaagctctgcccatcgtgctgaacatgttcgagaaagagctgagctcatacgcccaaagccacctggaaaacacctccatcaaggtgcacctgagaaccgccgtggccaaagtggaagagaagcagctgctggcaaagaccaagcacgaggacggtaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgctggcctgcctcctacagcccaggtggcccaccaggaagccgagtacctggccaagaacttcgacaagatggcccagatccccaatttccagaagaacctgtcctcccggaaggataagatcgatctgctgttcgaggaaaacaacttcaagcccttcaagtacaacgacctgggtgccctggcctacctgggcagcgaaagagccattgcaaccatcagaagcggcaagcggaccttctacaccggcggaggcctgatgaccttctacctgtggagaatcctgtacctgagcatgatcctgagcgcccgcagcagactgaaggtgttcttcgactggatcaagatggcctttttcaagagggacttcttcaagggactgtga

SEQ ID NO: 309 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgctagcaccagatccaccggcgtcgaaaacagcggggctggccccaccagcttcaagaccatgaaggtcatcgacccccagcacagcgacaagcccaacgtgctgatcctgggctctgggtggggcgccatcagctttctgaagcacatcgacaccaagaagtacaacgtctccatcatcagccccagaagctacttcctgttcacccccctgctgcccagcgcccctgtggggaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcctgagaaccacctaggcctgcaccaagccgagcccgccgaaattaagtacgactatctgatcagcgccgtgggcgccgagcctaacacctttggaatccccggcgtgaccgactacggccacttcctgaaagagattcccaactctctggaaatacggcggaccttcgccgccaatctagaaaaggccaacctgctgcctaagggcgaccccgagcggagaaggctgctgagcatcgtggtcgtgggtggaggccccacaggcgtggaagctgctggcgagctgcaggactacgtgcaccaggacctgcggaagtttttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccattccctacggcaccctgatttgggccaccggtaacaaggccagacccgtgatcaccgacctgttcaagaagatccccgagcagaacagcagcaagcggggcctggcagtgaacgacttcctgcaggtcaaaggcagcaacaacatcttcgccatcggcgacaacgcctttgccggcctgcctcctacagcccaggtggcccaccaagaggccgagtacctggccaagaactttgacaagatggcccagatccccaatttccagaagaacctgtcctcccggaaggataagatcgacctcctgttcgaggaaaacaacttcaagcccttcaagtacaacgacttaggcgccctggcctacctgggcagcgaaagagccattgccaccatccgtagcggcaagcggaccttctacaccggcggaggcctgatgaccttctacttatggcggatcctgtacctgagcatgatcctgagcgcccgctcgagactgaaggtgttcttcgactggatcaagatggccttcttcaagagggacttcttcaaaggcctgtga

SEQ ID NO: 310 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgctatcagctttctgaagcacatcgacaccaagaagtacaacgttagcatcatcagccccagaaagtacttcctgcacacccccctgctgcccagcgccccagtgggaaccgtagacgaaaagtccatcatcgagcccatcgtgaacttcgctctcaagaaaaagggcaacgtcacctactacgaggccgaggccaccagcatcaaccccgaccggaacaccgtgaccataaaaagcctgagcgccgtgtcccagctgtaccagcccgagaaccacctgggcctgcaccaggccgagcccgccgaaattaagtacgactacctgatcagcgccgtgggcgccgagcccaacacctttggaatccccggcgtgaccgactacggccacttcctgaaagaaatccccaacagcctggaaatccggcggaccttcgccgccaacctggaaaaggccaacctgctgcctaagggcgaccccgagcggagaaggctgctgagcattgtggtcgtgggcggaggccccacaggcgtggaagctgctggcgaactgcaggactacgtgcaccaggacctgagaaagttcctgcccgccttggccgaagaagtgcaaattcacctggtggaagccctgcccatcgttctgaacatgttcgagaagaagctgagcagctacgcccagagccacctggaaaacacctccatcaaggtgcacctgagaaccgccgtggccaaggtggaagagaagcagctgctggccaagaccaaacacgaggacggcaaaattaccgaggaaaccatcccctacggcaccttgatttgggccaccggcaacaaggccagacccgtgatcaccgacctgttcaagaagatccccgagcagaacagcagcaagagaggcctggcagtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataaaatcgacctgctgttcgaggaaaacaactttaagcccttcaagtacaacgacctgggtgccctggcctacctgggcagcgaaagagccattgcaaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaaaagggacttcttcaaaggcctgtga

SEQ ID NO: 311 - DNA, 1542 bp, Artificial Sequence
  source: /note="Description of Artificial Sequence: Synthetic polynucleotide"
atgctgagcaagaacctgtacagcaacaagcggttgctgaccagcaccaacaccctcgtgcgcttcgccagcaccagatccaccggcgtcgaaaacagcggggctggccccacctctttcaagaccatgaaggtcatcgacccccagcacagcgacaagcccaacgtgctgatcctgggctctggctggggcgctatcagctttctgaagcacatcgacaccaagaagtacaacgtcagcatcatcagccccagaagctacttcctgttcacccccctgatgccctctgcccctgtgggaaccgtggacgaaaagtccatcatcgagcccatcgtgaacttcgccctgaagaaaaagggcaacgtcacctactacgaggccgaggccaccagcatcaaccccgaccggaataccgtgaccatcaagagcctgagcgccgtgtcccagctgtaccagcccgagaaccacctgggcctgcaccaggccgaacccgccgagattaagtacgattacctgatcagcgccgtgggcgccgagcccaacacctttggtattcccggcgtgaccgactacggtcacttcttcaaagagatccccaacagcctggaaatcagacggaccttcgccgccaatctggaagaggccaacctgctgcctaagggcgaccccgagcggagaaggctgctgtccatcgtggtcgtgggcggaggccctacaggtgtggaagctgctggcgagctgcaggactacgtgcaccaggacctgcggaagttcctgcccgccctggccgaggaagtgcaaattcacctggtggaagccctgcccatcgtgctgaacatgttcgagaagaagctgagcagctacgcccagtcacacctggaaaacacctccatcaaagtgcacctgagaaccgccgtggccaaagtggaagagaagcagctgctggccaagaccaagcacgaagacggcaagattaccgaggaaaccatcccatacggcaccctgatttgggccaccggcaacaaggccagacccgtgatcaccgaccttttcaagaagatccccgagcaaaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgataagatggcccagatccccaatttccagaagaacctgtcctcccggaaggataagatcgatctgctgttcgaggagaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggactgtag

SEQ ID NO: 312 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctagtgcgcttcgccagcaccagatccaccggcgtcgaaaacagcggggctggccccaccagcttcaagaccatgaaggtcatcgacccccagcacagcgacaagcccaacgtgctgatcctgggctcgggctggggcgccatctcgtttctgaagcacatcgacaccaagaagtacaacgtcagcatcatcagccccagaagctacttcctgttcacccccctgttacccagcgcccctgtggggaccgtagacgaaaagtccattattgagcccatcgtgaacttcgctctgaagaaaaagggcaacgttacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgattacctgatcagcgccgtaggcgccgaacccaacacctttggaatccccggggtgaccgactacggccacttcttcaaagagatccccaacagcctggaaatccggcggaccttcgccgccaacctggaaaaggccaacctgctgcctaagggcgaccccgaacggagaaggctgctgagcatcgtggtcgtgggcggaggccccacaggcgtggaagctgctggtgagctgcaggactacgtgcaccaggacctgcggaagtttctccccgccctggccgaggaagtgcagattcacctggtggaagccctgcccatcgtgctgaacatgttcgagaagaagctgagcagctacgcccagagccacctggaaaacacttccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtgaaaggcagcaacaacatcttcgccatcggcgacaacgcctttagcggcctgcctcctacagcccaggtggcccaccaggaagccgagtacctggccaagaacttcgataagatggcccagatccccaatttccagaagaacctgtcctcaagaaaggataagatcgacctgctgttcgaggaaaacaacttcaagcccttcaagtacaacgacctgggcgccctggcctacctgggcagcgaaagagccattgccaccatcagaagcggcaagcggacattctacaccggtggaggcctgatgaccttctacctgtggcggatcctgtacctgagcatgatcctgagcgccagaagcagactgaaggtgttcttcgactggatcaagctggccttcttcaagagagacttcttcaaaggcctgtga

SEQ ID NO: 313 - DNA, 1542 bp, Artificial Sequence
  source: /note="Description of Artificial Sequence: Synthetic polynucleotide"
atgctaagcaagaacctgtacagcaacaagcggctgctgaccagcaccaataccctcgtgcgcttcgccagcaccagatccaccggcgtcgaaaacagcggggcaggccccaccagcttcaagaccatgaaagtcatcgacccccagcacagcgacaagcccaacgtgctgatcctgggttctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggcagaagccaccagcatcaaccccgaccggaataccgtgaccatcaagtcactgagcgccgtgtcccagctgtaccaacccgagaaccatctgggcctgcaccaggccgagcccgccgagattaagtacgattacttaatcagcgccgtgggcgccgagcccaacacctttggtatccccggcgtgaccgattacggccacttcctgaaagagatccccaacagcttggaaatccggcggacctttgccgccaatctggaaaaggccaacctgttgcctaagggcgaccccgagcggagaaggctgctgagcattgtggtcgtgggcggaggccccacaggcgtggaagctgctggcgagctgcaggactacgtgcaccaggacctgcggaagttcttccctgccctggccgaggaagtccagattcacctggtggaagccctgcccatcgtgctgaacatgttcgagaagaagctgtcaagctacgcccagagccacctggaaaacacttccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggcagtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaatctgtcctcccggaaggataagattgacctcctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtag

SEQ ID NO: 314 - DNA, 1542 bp, Artificial Sequence
  source: /note="Description of Artificial Sequence: Synthetic polynucleotide"
atgctgagcaagaatctgtacagcaacaagcggctgctgaccagcaccaacaccctcgtgcgcttcgcctccaccagatccaccggcgtcgaaaacagcggagctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtatttcctgcacacccccctgctgcccagcgcccctgtgggaaccgtggacgagaagtccattatcgagcccatcgtgaacttcgccctgaagaaaaaggggaacgtcacctactacgaggccgaggccaccagcatcaatcccgaccggaacaccgtgaccatcaagaacctgagcgccgtgtcccagctgtaccagcccgagaaccacctgggcctgcaccaggccgagcccgccgaaattaagtacgactacttaatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccctacaggtgtggaagctgctggcgagctgcaggattacgtgcaccaggacctgcggaagttcctccccgccctggccgaggaagtccagattcacctggtggaagccctgcccatcgtgctgaacatgttcgagaagaagcttagcagctacgcccagagccacctggaaaacacctccatcaaagtgcacctgagaaccgccgtggccaaggtggaagagaagcagctgctggcaaagaccaagcacgaggacggcaagattaccgaagaaaccatcccctacggcaccctgatttgggccacgggtaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcatttgccggcctgcctcctacagcccaggtggcccaccaggaagccgagtacctggccaagaacttcgacaagatggcccagatccccaatttccagaagaacctgtcctcccggaaggataaaatcgatctgttgttcgaggaaaacaacttcaagcccttcaaatacaacgacctgggcgccctggcctacctgggcagcgaaagagccattgcaaccatcagaagcggcaagcggaccttctacaccggcggaggcctgatgaccttctacctgtggcggatcctgtacttgagcatgatcctgagcgccagaagcagactgaaggtgttcttcgactggatcaaactggccttcttcaagagggacttcttcaagggcctgtga

SEQ ID NO: 315 - DNA, 1542 bp, Artificial Sequence
  source: /note="Description of Artificial Sequence: Synthetic polynucleotide"
atgctgagcaagaacctgtacagtaacaagcggctgctgaccagcacgaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctcggggtggggcgccatcagctttctgaagcacattgacaccaagaagtacaacgtcagcatcatcagccccagaaagtacttcctgttcacccccctgctgcccagcgcccctgtgggaaccgtggacgaaaagtccatcatcgagcccatcgtgaacttcgccctgaagaaaaagggcaacgtcacctactacgaggccgaggccaccagcatcaatcccgaccggaacaccgtgaccatcaagaacctgagcgccgtgtcccagctgtaccagcccgaaaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctagaaaaggccaacctgttgcctaagggcgaccccgagcggagaaggctactgagcatcgtggtcgttggcggaggccctacaggcgtggaagctgctggcgagctgcaggactacgtgcaccaggacctgcggaagttcctgcctgccctggccgaggaagtgcagattcacctggtggaagccctgcccatcgttctgaacatgttcgagaagaagctgagcagctacgcccagagccacttagaaaacacctccatcaaggtgcacctgagaaccgccgtggccaaggttgaagagaagcaactgctggccaagaccaagcacgaggacggtaagattaccgaggaaaccatcccctacggcaccctgatttgggccaccggcaacaaggccagaccggtgatcaccgacctgttcaagaagatccccgagcagaacagcagcaagcggggcctggccgtgaatgacttcctgcaggtcaaaggcagcaacaacattttcgccatcggcgacaacgcctttgccggcctgcctcctacagcccaggtggcccaccaggaagccgaatacctggccaagaacttcgacaagatggcccagatccccaatttccagaagaacctgtcctcccggaaggataaaatcgacctgctgttcgaggaaaacaacttcaagcctttcaagtacaacgacctgggcgccttagcctacctgggcagcgaaagagccattgccaccatcagaagcggcaagcggaccttctacaccggcggaggcctgatgaccttctacctgtggcagatcctgtacctgtccatgatcctgagcgcccgcagcagattaaaggtgttcttcgactggatcaagctggccttcttcaagagggacttcttcaaaggcctgtga

SEQ ID NO: 316 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcattgaccctcagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgctctgaagaaaaaggggaacgtcacctactacgaggccgaggccaccagcatcaaccccgaccggaacaccgtgaccataaagtcactgagcgccgtgtcccagctgtaccagcctgagaaccacctaggcctgcaccaggccgagcccgccgagattaagtacgactatctgatcagcgccgtaggtgccgagcccaacacatttggaattcccggcgtgaccgactacggccacttcttcaaagagatccccaacagcctggaaatccggcggaccttcgccgccaacctggaagaggccaacttattgcctaagggcgaccccgagcggagaaggctgctgtccatcgtggtcgtgggcggaggccccacaggcgtggaagctgctggcgagctgcaggactacgttcaccaggacctgcggaagttcctgcccgccctggccgaggaagtgcaaattcacctggtggaagccctgcccatcgtgctgaacatgtttgagaagaagctgagcagctacgcccagagccacctggaaaacacctccatcaaggtgcacctgagaaccgccgtggccaaggttgaagagaagcagctgctggccaagaccaagcacgaggacggcaagattaccgaggaaaccatcccctacggcaccctgatttgggccacgggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgccacctacagcccaggtggcccaccaggaggccgagtacatcgccaagaacttcgacaagatggcccagatccccaatttccagaagaacctgtcctcacggaaggataagatcgacctgctgttcgaggagaacaacttcaagcccttcaagtacaacgacctgggcgccctggcctacctgggcagcgaaagagccattgccaccatcagaagcggtaagcggaccttttacaccggcggaggcctgatgaccttctacctgtggcggatcctgtacctgagcatgattctgagcgcccgcagcagactgaaggtgttcttcgactggatcaagttagccttcttcaagagggacttcttcaagggcctgtga

SEQ ID NO: 317 - DNA, 1542 bp, Artificial Sequence
  source: /note="Description of Artificial Sequence: Synthetic polynucleotide"
atgctgagcaagaacttgtatagcaacaagcggctgctgaccagcacgaacaccatggtgagattcgctagcaccagatccaccggggtcgaaaacagcggggctggccccaccagcttcaagaccatgaaggtcattgacccccagcacagcgacaagcccaacgtgctgatactgggctctggctggggcgctatcagctttttaaagcacatcgacaccaagaagtacaacgtcagcatcatctctcccagaagctacttcctgttcacccccctgctgcccagcgccccagtgggaaccgtggacgagaagtccatcatcgagcccatcgtgaacttcgccctgaagaaaaagggcaacgtcacctactacgaggccgaagccaccagcatcaatcccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcctaacacctttggaatccccggcgtgaccgactacggtcacttcctgaaagagatccccaacagcctggaaatccggcggaccttcgccgccaacctggaagaggccaacctgctgcctaagggcgatcccgagcggagaaggctgctgagcatcgtggtcgtgggcggaggccccacaggcgtggaagccgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtacacctgagaaccgccgtggccaaggtggaagagaagcaactgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccgggctgccacctacagcccaggtggcccaccaggaagccgagtacctggccaagaacttcgacaagatggcccagatccccaatttccagaagaacctgtcctcccggaaggataagatcgacctcctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctaagcgcccgcagcagattaaaggtgttcttcgactggattaaactggccttcttcaagagggactttttcgagggcttatga

SEQ ID NO: 318 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtggaaaacagcggggctggccctacaagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgatgcccagcgcccctgtgggaaccgtggacgagaagtccatcatcgagcccatcgtgaactttgccctgaagaaaaagggcaacgtcacctactacgaggccgaggccacctctatcaatcccgaccggaacaccgtgaccatcaagagcctgagcgccgtgtcccagctgtaccagcccgagaaccacctggggctgcaccaggccgagcccgccgagattaagtacgactacctgatcagcgccgtaggcgccgagcccaacacctttggaatccccggcgtgactgactacggccacttcctgaaagagatccccaacagcctggaaatccggcggaccttcgccgccaacctggaaaaggccaacctgttgcctaagggcgaccccgagcggagaaggctgctgagcatcgtggtcgtgggcggaggccccacaggcgtggaagctgctggtgagctgcaggactacgtgcaccaggacctgcggaagttcctgcccgccctggccgaggaagtccagattcacctggtggaagccctgcccatcgttctgaacatgttcgagaaggagctgtcaagctacgcccagagccacctggaaaacacctccatcaaggtgcatctgagaacggccgtcgccaaggtggaagagaagcagctgctggccaagaccaagcacgaggacggcaagattaccgaggaaaccatcccctacggtaccctgatttgggccaccggcaacaaggccagacccgtgatcaccgacctgttcaagaaaatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaagaagccgagtacctggccaagaacttcgacaagatggcccagatccccaatttccagaagaacctatcttcccggaaggataagatcgacctgctgttcgaggaaaacaacttcaagcccttcaagtacaacgacttaggcgccctggcctacctgggcagcgaaagagccattgcaaccatcagaagcggcaagagaaccttctacaccggcggaggcctgatgaccttctacctgtggcggatcctgtacttgagcatgatcctgagcgcccgcagcagattaaaggtgttcttcgactggattaagttagccttcttcaagagggacttcttcaagggcctgtga

SEQ ID NO: 319 - DNA, 1542 bp, Artificial Sequence
  source: /note="Description of Artificial Sequence: Synthetic polynucleotide"
atgctgagcaagaacttgtacagcaacaagcggctgctgaccagcaccaacaccatggtgcgcttcgccagcaccagatccaccggcgtcgaaaacagcggggctggtcccaccagcttcaagaccatgaaggtcatcgacccccagcacagcgacaagccaaacgtgctgatcctgggctctggctggggcgccatcagctttctgaagcacatcgacaccaagaagtacaacgtctccatcatctctcccagaagctacttcctgttcacccccctgctgcccagcgcccctgtgggaaccgtggacgagaagtccatcatcgagcccatcgtgaatttcgccctgaagaaaaagggcaacgtcacctactacgaggccgaagccaccagcatcaaccccgaccggaacaccgtgaccatcaagagcctgtctgccgtgtcccagctgtaccagcccgagaaccacctgggcctgcaccaggccgagcccgccgaaattaagtacgactacctgatcagcgccgtgggcgccgagcccaacacatttggaatccccggcgtgaccgactacggccacttcctggaggagatccccaacagcctggaaatccggcggaccttcgccgccaacctggaaaaggccaacctgttgcctaagggtgaccccgagcggagaagactactgagcatcgtggtcgtgggcggagggcctactggcgtggaagctgctggcgagctgcaggactacgtgcaccaggacctgagaaagttcctgcccgccctggccgaggaagtgcagattcacctggtggaagccctgcccatcgtgctgaacatgttcgagaagaagcttagcagctacgcccagagccacttagaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggcaagacccgtgatcaccgacctgttcaagaagatccccgagcagaacagcagcaagagaggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccaaatccccaatttccagaagaacctgtcctcccggaaggataagatcgatctgctgttcgaggaaaacaacttcaagcccttcaagtacaacgacctgggcgccctggcatacctgggaagcgaaagagccattgccaccatcagaagcggcaagcggaccttctacaccggcggaggcctgatgaccttctacctgtggcagattctgtacctgagcatgatcctgtctgcccgcagcagattaaaggtgttcttcgactggatcaagctggccttcttcaagagggacttcttcaagggcctgtga

SEQ ID NO: 320 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggggtcgaaaacagcggggctggccccaccagcttcaagaccatgaaggtcatcgacccccagcacagcgacaagcccaacgtgctgatactgggctctggctggggcgccatctcgtttctgaagcacatcgacaccaagaagtacaacgtcagcatcatctctcccagaagctacttcctgttcacccctctgctgcccagcgcccctgtgggaaccgtggacgagaagtcaatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctataccagcccgagaaccacctgggcctgcaccaggccgagcccgccgagattaagtacgactacctgatcagtgccgtaggcgccgagcccaacacctttggaattcccggcgtgaccgactacggccacttcctgaaagagatccccaacagcctggaaatccggcggaccttcgccgccaacctggaaaaggccaacctgctgcctaagggcgaccccgaaagaagaaggctactgagcatcgtggtggtgggcggaggccccacaggcgtggaagctgctggcgagctgcaggactacgtgcaccaggacctgcggaagttcctgcccgcactggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaaaattcccgagcaaaacagcagcaagcggggcctggccgtgaacgacttcttgcaggtcaaaggcagcaacaacatcttcgccatcggcgacaacgcctttagcggcctgcctcctaccgcccaggtggcccaccaggaagccgaatatatcgccaagaacttcgacaaaatggcccagatccccaatttccagaagaacctgtcctcccggaaggataagatcgatctgctgttcgaggaaaacaacttcaagcccttcaagtacaacgacctgggcgccctggcctacctgggcagcgaaagagccattgccaccatcagaagcggcaagcggaccttctacaccggtggtggcctgatgaccttctacctgtggcagatcctgtacctgtccatgatcctgagcgcccgcagcagactgaaggtgtttttcgactggatcaagctggccttcttcaagagggacttcttcaagggcctgtga

SEQ ID NO: 321 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgcttccaccagatccaccggcgtcgaaaactccggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatctctcccagaaagtacttcctgttcacccccctgctgcccagcgcccctgtggggaccgtggacgagaagtccatcatcgagcccatcgtgaacttcgccctcaagaaaaagggcaacgtcacctactacgaggccgaggccaccagcatcaaccccgaccggaacaccgtgaccatcaagagcttaagcgccgtgtcccagctgtaccagcccgagaaccacctgggcctgcaccaagccgagcccgccgaaattaagtacgactacctgatcagcgccgtgggcgccgagcccaacacctttggaatccccggcgtgaccgactacggccacttcctgaaagagatccccaacagcctggaaatcagacggactttcgccgccaacctggaagaggccaacctgctgcctaagggcgaccccgagcggagaaggctgctgagcatcgtggtcgtgggtggaggccccacaggcgtggaagctgctggcgagctgcaggactacgtgcaccaggacctgcggaagttcctccccgccttggccgaggaagtgcagattcacctggtggaagccctgcccatcgtgctgaacatgttcgagaaggagctgtcaagctacgcccagagccacctggaaaacacctcgatcaaggtgcacctgagaaccgccgtggccaaggtggaagagaagcagctgctggccaagaccaagcacgaggacggcaagattaccgaggaaaccatcccctacggtaccctgatttgggccaccggcaacaaggccagacccgtgatcaccgacctgttcaagaagatccccgagcagaacagcagcaagcggggcctggcagtgaacgacttcctgcaggtcaaaggcagcaacaacatcttcgccatcggcgacaacgcctttgccggcctgcctcctaccgcccaggtggcccaccaggaagccgagtacttggccaagaactttgataagatggcccaaatccccaatttccagaagaacctgtcctcccggaaggataagatcgacctcctgttcgaggagaacaacttcaagcccttcaagtacaacgacctgggcgccctggcctacctgggcagcgaaagagccattgccaccatccgtagcggcaagcggaccttctacaccggcggaggcttaatgaccttctacctgtggcggatcctgtacctgagcatgatcctgagcgcccgcagcagactgaaggtgttcttcgactggattaagctggccttcttcaagagggacttcttcaagggcttatga

SEQ ID NO: 322 - DNA, 1542 bp, Artificial Sequence
  source: /note="Description of Artificial Sequence: Synthetic polynucleotide"
atgctgagcaagaacctgtacagcaacaagcggttgctgaccagcaccaacaccatggtgcgcttcgccagcaccagatccaccggcgtcgaaaacagcggagctggtcccacctctttcaagaccatgaaggtcatcgacccccagcacagcgacaagcccaacgtgctgatcctgggctctggctggggcgccatcagctttctgaagcacattgacaccaagaagtacaacgtcagcatcatcagccccagaagctacttcctgttcacccccctgctgccttctgcccctgtgggaaccgtggacgagaagtccatcattgagcccatcgtgaactttgccctgaagaaaaagggcaacgttacctactatgaggccgaggccaccagcatcaaccccgaccggaacaccgtgaccatcaagagcctgagcgccgtgtcccagctgtaccagcccgagaaccatctgggcctgcatcaggccgagcccgccgagattaagtacgactacttaatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggtgagctgcaggactacgtgcaccaggacctgagaaagttcctgcccgccctggccgaggaagtgcagattcacctggtggaagccctgcccatcgtgctgaacatgttcgagaaggagctgagcagctacgcccagagccacctggaaaacacctcgatcaaggtgcacctgagaaccgccgtggccaaggtggaagagaagcagttgctggccaagaccaaacacgaggacggcaagattaccgaggaaaccatcccctacggcactctgatttgggccaccggcaacaaggccagacccgtgatcactgacctgttcaagaagatccccgagcagaacagcagcaagcggggactggccgtgaacgacttcctgcaggtcaaaggcagcaacaacatcttcgccatcggcgacaacgcctttgccggcctgcctcctacagcccaggtggcccaccaggaagccgaatacctggccaagaacttcgacaagatggcccagatcccaaatttccagaagaacctgtcctcccggaaggataagatcgacctgctgttcgaggaaaacaacttcaagcccttcaagtacaacgacctgggtgccctggcctacctgggcagcgaaagagccattgccaccatcagaagcggcaagcggaccttctacaccggtggaggcctgatgaccttctacttatggcggatcttgtacctgagcatgatcctgagcgcccgcagcagactgaaggtgttcttcgactggatcaagatggccttcttcaagagggacttcttcaaaggcctgtga

SEQ ID NO: 323 - DNA, 1542 bp, Artificial Sequence
  source: /note="Description of Artificial Sequence: Synthetic polynucleotide"
atgctgagcaagaacctgtacagcaacaagcggctgctgacctcgacgaacaccctcgtgcgcttcgccagcaccagatccaccggcgtcgaaaacagcggggctggccccaccagcttcaagaccatgaaggtcatcgacccccagcacagcgacaagcccaacgtgctgatactgggctctggctggggcgccatcagctttctgaagcacatcgacaccaagaagtacaacgtcagcatcatcagccccagaaagtacttcctgttcacccccctgatgccctctgcccctgtgggaaccgtggacgagaagtccatcatcgagcccatcgttaacttcgccctgaagaaaaagggcaacgtcacctactacgaggccgaggccacctctatcaaccccgaccggaacaccgtgaccataaagagcctgagcgccgtgtcccagctataccagcccgagaaccacctgggcctgcaccaagccgagcccgccgagattaagtacgactacctgatcagcgccgtgggcgccgagcccaacacctttggaattcccggggtgaccgactacggccacttcctgaaagagatccccaacagcctggaaatccggcggacctttgccgccaacctggaaaaggccaacctgctgcctaagggcgaccccgagcggagaaggctgctgagcatcgtggtcgtgggcggtggccccacaggcgtggaagctgctggcgagctgcaggactacgtgcaccaggacctgcggaagttcctgcccgcactggccgaagaagtgcagattcacctggtggaagccctgcccatcgtgctgaacatgtttgagaagaagctgagcagctacgcccagtcacacctggaaaacacctccatcaaggtgcacctgagaaccgccgtggccaaggtggaagagaagcaactgctggccaagaccaagcacgaggacggcaagattaccgaggaaaccatcccctacggtaccctgatttgggccaccggcaacaaggccagacccgtgatcaccgacctgttcaagaagatccccgagcagaacagcagcaagagaggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggctcagatccccaatttccagaagaacctgtcctcccggaaggataaaatcgacctgttgttcgaggaaaacaacttcaaacccttcaagtacaacgacctgggcgccctggcctacctgggcagcgaaagagccattgccaccatcagaagcggcaagagaaccttctacaccggcggaggcctgatgaccttctacctgtggcagatcttgtacctgagcatgatcctgtctgccagaagcagactgaaggtgttcttcgactggatcaagctggccttcttcaagagggactttttcaagggcctgtga

SEQ ID NO: 324 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttagcggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 325 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagatggccttcttcaagagggacttcttcaagggcctgtga

SEQ ID NO: 326 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 327 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttagcggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacctgagcatgatcctgagcgcccgcagcagactgaaggtgttcttcgactggatcaagctggccttcttcaagagggacttcttcaagggcctgtga

SEQ ID NO: 328 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 329 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcgagggcctgtga

SEQ ID NO: 330 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacatgagcatgatcctgagcgcccgcagcagactgaaggtgttcttcgactggatcaagctggccttcttcaagagggacttcttcaagggcctgtga

SEQ ID NO: 331 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcgagggcctgtga

SEQ ID NO: 332 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagatggccttcttcaagagggacttcttcaagggcctgtga

SEQ ID NO: 333 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 334 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcgagggcctgtga

SEQ ID NO: 335 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 336 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagatggccttcttcaagagggacttcttcaagggcctgtga

SEQ ID NO: 337 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacctgagcatgatcctgagcgcccgcagcagactgaaggtgttcttcgactggatcaagctggccttcttcaagagggacttcttcaagggcctgtga

SEQ ID NO: 338 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 339 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacctgagcatgatcctgagcgcccgcagcagactgaaggtgttcttcgactggatcaagctggccttcttcaagagggacttcttcaagggcctgtga

SEQ ID NO: 340 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 341 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 342 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttgagggattatag

SEQ ID NO: 343 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttacacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaattagcatttttcaaaagagacttttttgagggattatag

SEQ ID NO: 344 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttagcgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 345 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaaatggcatttttcaaaagagacttttttaaaggattatag

SEQ ID NO: 346 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttacacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 347 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 348 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaaatggcatttttcaaaagagacttttttaaaggattatag

SEQ ID NO: 349 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttgagggattatag

SEQ ID NO: 350 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttacacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaaatggcatttttcaaaagagacttttttgagggattatag

SEQ ID NO: 351 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttacacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttagcgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaaatggcatttttcaaaagagacttttttaaaggattatag

SEQ ID NO: 352 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 353 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaattagcatttttcaaaagagacttttttaaaggattatag

SEQ ID NO: 354 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttacacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 355 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 356 - DNA, 1542 bp, Artificial Sequence
  source: /note="Description of Artificial Sequence: Synthetic polynucleotide"
atgctatcgaagaatttgtatagtaaccggaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttgagggattatag

SEQ ID NO: 357 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttacacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttagcgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaaatggcatttttcaaaagagacttttttaaaggattatag

SEQ ID NO: 358 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacatgtccatgattctatctgcaagatcgagattaaaggtctttttcgactggattaaaatggcatttttcaaaagagacttttttaaaggattatag

SEQ ID NO: 359 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaaatggcatttttcaaaagagacttttttgagggattatag

SEQ ID NO: 360 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaaatggcatttttcaaaagagacttttttgagggattatag

SEQ ID NO: 361 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttacacacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 362 - DNA, 1542 bp, Artificial Sequence
  source: /note="Description of Artificial Sequence: Synthetic polynucleotide"
atgctgtcgaagaatttgtatagtaaccggcggttgctgacctcgaccaacacgatggtgcgcttcgctagcaccagatccacaggcgtggaaaactccggagcaggccctacatcttttaagaccatgaaggtcatcgacccccagcacagcgacaaaccaaacgtgctgatactgggttcggggtggggcgctatttcgtttttaaagcacattgacaccaagaagtacaacgtcagcatcatctctcctagaagctacttcctgtttacgcccttgatgcctagcgcaccagtggggacagtagacgaaaagtcaattattgagcccatcgtgaatttcgctctcaagaaaaaggggaacgttacctactatgaggcagaagccacctctatcaaccccgaccggaacaccgtgaccatcaaatcattatctgccgtgagccagctataccaacccgaaaaccatctggggctgcatcaagcagaacctgctgaaattaagtacgattatttaatcagtgctgtaggtgccgaacctaacacctttggtatccccggcgtcactgattacggccacttcctgaaggaaattcccaacagcctggaaataagacggacttttgccgccaatctagaagaggctaacttattgccaaagggtgatcccgaaagaagaagactactgagcattgtcgtcgttggtggagggcctacaggcgtagaggccgctggtgaactacaggattatgttcaccaggacctgcggaagtttttccccgcattggccgaggaagtccagattcacttggtggaagccctgcccatcgtgttgaatatgtttgagaaaaagcttagctcatacgcgcaatcacatttagaaaacacctcgatcaaagtacatctgagaacggctgtggccaaagttgaagaaaagcaattgctggcaaagaccaaacacgaggacggtaaaataaccgaggaaactattccatacggcactctgatttgggccacgggtaacaaggcaagacccgtaatcaccgacctgttcaagaaaatccctgagcaaaactcgtccaagagaggattggccgtgaatgacttcttgcaggtcaaaggcagcaacaacatcttcgccattggtgacaacgcatttgctggcttgccaccaaccgcccaggtagcgcaccaggaagccgaatatttggccaagaacttcgataagatggcccagatcccaaatttccagaagaacctatcttcacggaaggataaaattgacctgttgttcgaggaaaacaacttcaagcccttcaaatacaacgatttaggtgccttagcatacctgggctccgaaagggccattgccaccatacgttccggtaagagaacattttacaccggcggtggcctgatgaccttctacttatggagaattttgtacttgtccatgattctaagcgcaagatcgagactgaaggtcttcttcgactggattaagttagcatttttcaaaagagacttttttaaaggactgtga

SEQ ID NO: 363 - DNA, 1542 bp, Artificial Sequence
  source: /note="Description of Artificial Sequence: Synthetic polynucleotide"
atgctatcgaagaacttgtacagtaacaagaggttgctgacctcgacgaataccctagtgcgcttcgcttccaccagatccaccggcgtggaaaactccggagcaggtcccacatcttttaagaccatgaaagtcattgaccctcagcacagcgacaaacccaacgtgctgatactgggttcgggctggggcgctattagctttctgaagcacattgacaccaagaagtacaacgttagcatcatctctcccagaagctacttcttatttacccctctgttaccttctgcacctgttgggacagtagacgaaaagtcaatcattgagcccatcgtgaattttgccctcaagaaaaaggggaacgtcacctactacgaggcagaggccacctctatcaatcccgaccggaataccgttaccataaagtcattatctgccgttagccagctataccaacccgaaaaccatctgggcatgcatcaagcagaacctgctgagattaagtacgattacctgatcagtgctgtaggtgcggaacctaacacctttggtattcctggggtcactgactacggtcatttcctggaggaaattcccaactctttggaaataagaagaaccttcgccgccaacctggagaaggctaacttattgcctaagggtgaccccgaaagaagaagactgctgagcattgtcgtcgtgggtggaggccctactggtgtggaagccgctggcgagctacaggactacgttcaccaggacctgagaaagttcttccccgcactggccgaagaagtgcaaattcacctggtcgaagccctgcccatcgttttgaatatgtttgagaaagagcttagctcatacgcgcaaagccatttagaaaacacttcgatcaaagtacatctgagaaccgccgtcgccaaggttgaagagaagcaattgttggcaaagaccaaacacgaagacggtaaaataaccgaggaaaccattccatacggtactttgatttgggccaccggtaacaaggccagacccgtgatcactgacctgttcaagaaaatccctgagcaaaactcgagcaagagaggattggcagtgaatgacttcttgcaggtggagggcagcaacaacattttcgccattggtgacaatgcatttgctgggctgcctcctaccgcccaggtagcgcaccaagaggccgaatacttggccaagaactttgataaaatggctcaaataccaaatttccaaaagaatctatcttcaagaaaggataaaattgatctcctgttcgaggagaacaactttaaacctttcaaatacaacgatttaggtgccttagcatacctgggctccgaaagggccattgcaaccatacgttccggcaagagaacattttacaccggtggtggcttaatgaccttctacttatggagaattctgtacctgtccatgatcctgagcgcaagaagcagattaaaggtgtttttcgactggatcaagctggcattcttcaaaagagacttcttcaaaggcttatga

SEQ ID NO: 364 - DNA, 1542 bp, Artificial Sequence
  source: /note="Description of Artificial Sequence: Synthetic polynucleotide"
atgctaagcaagaatttgtatagtaacaagaggttgctcaccagcacgaacacgctagtcagattcgcctccaccagatccacaggggtggaaaactccggggcaggtcctacaagcttcaagaccatgaaagtcattgacccccagcacagcgacaaaccaaacgtgctgatcctgggttcgggctggggagccatctcgtttttaaagcacattgacaccaagaagtacaacgtttccatcatcagccctagaaagtatttcttattcacccccttgttacctagcgccccagttgggacagtagacgaaaagtccattattgagcccatcgtgaattttgccctcaagaaaaaggggaacgtcacctactatgaggcagaagccacctctatcaatcccgaccggaacaccgttaccataaaaaacctgagcgccgtgagccagctataccaacctgaaaaccatctggggctgcatcaagcagaacctgccgaaattaagtacgattatttaatcagcgctgtgggtgcggaacccaacacatttggtatccctggggtcactgattacggtcatttcctgaaggaaattcccaactctttggaaatccggagaacttttgccgccaatctggagaaggctaacttattgcctaagggtgatcccgaaagaagaaggctactgagcattgtcgtggtgggtggtgggcctactggtgtagaagccgctggtgagctgcaggattacgttcaccaggacctgagaaagtttctccctgccttggccgaagaagtccagattcacttggtggaagccctgcccatcgtgttgaatatgtttgagaaggagctttcatcatacgcgcaatcacacttagaaaacacctcgatcaaggtgcatctgagaacggctgtggccaaagtggaagagaagcagttgctggcaaagaccaaacacgaagacggtaaaattaccgaggaaactatcccatacggcaccttgatttgggccacgggtaacaaggcaagaccggtaatcaccgaccttttcaagaaaatccctgagcaaaactcgtccaagcggggactggccgtgaatgactttctgcaggtggagggcagcaacaacatcttcgccatcggcgacaacgcctttgctggcttgccaccaaccgcccaggtagcgcaccaagaggccgaatatatcgccaagaattttgataaaatggctcaaataccaaatttccaaaagaatctatcctccagaaaggataagatcgatctcttgttcgaggagaacaactttaagcctttcaagtacaacgatttaggtgccttagcatacctgggatccgaaagggccattgccaccatacgttccggtaagcggaccttctacaccggcggtggcttaatgaccttctacttatggagaatcttgtacctgtccatgatcctatctgccagatcgagactgaaggtctttttcgactggatcaaattagccttcttcaaaagggacttttttaagggattatga

SEQ ID NO: 365 - DNA, 1542 bp, Artificial Sequence
  source: /note="Description of Artificial Sequence: Synthetic polynucleotide"
atgctatcgaagaatttgtatagtaacaagcggttgctcacctcgacgaatacgatggtcagattcgcctccaccagatccacaggggtggaaaacagcggggcaggtcctacatcttttaagaccatgaaggtcattgaccctcagcacagcgacaaaccaaacgtgctgatactgggttcggggtggggcgctatttcgtttttaaagcacatcgacaccaagaagtacaacgtttccatcatctctcccagaaagtatttcttatttacgcctttgttaccttctgccccagttgggaccgtggacgaaaagtccattattgagcccatcgttaattttgctctgaagaaaaagggcaacgttacctactatgaggccgaagccacctctatcaaccccgacaggaataccgtgaccatcaaaagcttatctgccgtttcccagctgtaccaacccgaaaaccatctagggctgcatcaggcagagcctgccgaaattaagtacgattatttaatcagtgctgtaggcgcggaacccaacacatttggtattcccggcgtcactgattacggtcatttcctgaaagagattcccaactctttggaaatcagaagaacctttgccgccaatctagagaaggctaacttattgcctaagggcgaccccgaaagaagaagactactgtccatcgtcgtcgttggtggtggccccactggcgtggaggccgctggcgaactgcaggattatgttcaccaggacctgcggaagtttttccccgccttggccgaagaagtccaaattcacttggtcgaagccctgcccatcgtgttgaatatgttcgagaaaaagctttcatcatacgcgcagtcacatctggaaaacacctcgatcaaagtgcatctgagaacggctgtcgccaaagtggaagaaaagcaattgctggcaaagaccaaacacgaagacggcaaaattaccgaggaaactattccctacggcactctgatttgggccaccggcaacaaggccagaccggtaatcactgaccttttcaagaaaattcctgagcaaaactcgtccaagagaggattggcagtgaatgactttttgcaggtcaaaggcagcaacaacattttcgccattggtgacaacgcctttgctgggttgccaccaacagcccaagtggcccaccaagaggccgagtatctggccaagaactttgataagatggctcagataccaaatttccaaaagaacctatcttccagaaaggataagattgatctcttgttcgaggagaacaactttaaacccttcaagtacaacgacctgggtgccctggcatacctgggctccgaaagggccattgcaaccatacgttccggcaagagaaccttctacaccggtggaggcctgatgaccttctacttatggcggattttgtacttgtccatgattctaagcgcacgcagcagactgaaggtctttttcgactggattaaaatggcatttttcaaaagggacttttttgagggcctgtga

SEQ ID NO: 366 - DNA, 1542 bp, Artificial Sequence
  source: /note="Description of Artificial Sequence: Synthetic polynucleotide"
atgctatcgaagaatttgtatagtaacaagcggttgctgacctcgaccaacacgctcgtgagattcgcttccaccagatccaccggggtggaaaactccggggcaggccctacatcttttaagaccatgaaagtcatcgaccctcagcacagcgacaaacccaacgtgctgatcctgggttcggggtggggagctattagctttttaaagcacattgacaccaagaagtacaacgttagcatcatcagccccagaaagtacttcttattcacccctctgttaccttctgcaccagttgggacagtagacgagaagtcaattattgagcccatcgttaattttgctctcaagaaaaaggggaacgtcacctactatgaggcagaggccaccagcatcaatcccgaccggaataccgtgaccataaaatcactgtctgccgttagccagctataccagcctgagaaccatctgggcctgcaccaagcagaacccgctgaaattaagtacgattatttaatcagtgctgtaggtgccgaacctaacacctttggtattcctggcgtcactgattacggtcatttcctgaaagaaattcccaacagcttggaaatacggagaacctttgccgccaatctagagaaggctaacttattgcctaagggcgaccccgaaagaagaagactgctgtccattgtggtggtgggtggtgggcccactggcgtagaggctgctggtgagctacaggattatgttcaccaggacctgagaaagtttctccctgccttggccgaagaagtgcaaattcacttggtcgaagctctgcccatcgttttgaacatgttcgagaaaaagcttagcagctacgcgcaatcacatttagaaaacacttccatcaaagtacacctgagaacggctgtggccaaagtggaagaaaagcagttgctggcaaagaccaaacacgaggacggcaagataaccgaagaaactattccatacggtactttgatttgggccacgggtaacaaggcaagacccgtaatcaccgacctgttcaagaagattcctgagcagaactcgtccaagcggggattggccgtgaatgacttcctgcaggtcgagggcagcaacaacatcttcgccattggcgacaatgcatttgccgggttgccaccaaccgcccaagtagcgcaccaagaagccgaatatatcgccaagaattttgacaagatggctcaaatcccaaatttccaaaagaatctgtcttcaagaaaggataagattgatctcttgttcgaggagaacaactttaaacctttcaaatacaacgatctgggcgccctggcatacctgggaagcgaaagggccattgcaaccatccgtagcggtaagagaacattctacaccggtggtggcctgatgaccttctacttatggagaattctgtacatgtccatgattctatctgccagatcgagattaaaggtctttttcgactggattaagttagccttcttcaagagagacttttttgagggactgtag

SEQ ID NO: 367 - DNA, 1542 bp, Artificial Sequence
  source: /note="Description of Artificial Sequence: Synthetic polynucleotide"
atgctatcgaagaatctgtacagtaacaagcggttgctcacctcgacgaataccctcgtcagattcgctagcaccagatccacaggcgtcgaaaactccggggcaggtcctacatctttcaagaccatgaaagtcattgacccccagcacagcgacaaaccaaacgtgctgatactgggctctgggtggggagctatttcgtttctgaagcacattgacaccaagaagtacaacgttagcatcatctctcctagaaagtacttcttacacacgcccctgttaccttctgcaccagtggggaccgtagacgaaaagtccatcattgagcccatcgttaatttcgctctcaagaaaaaggggaacgttacctactatgaggcagaagccacctctatcaatcccgacaggaataccgttaccatcaaatcattaagcgccgtttcccagctataccagcctgaaaaccacctaggcatgcaccaagcagaacccgctgagattaagtacgattatctgatcagtgccgtaggtgcggaacccaacacatttggaatccctggggtcaccgattacggtcatttcctggaggaaatccccaactctctggaaataagaagaacttttgccgccaatctagagaaggccaacctgttgccaaagggtgatcccgaacggagaagactactgagcattgtggtggttggcggtggccctactggtgtagaagctgctggtgaactacaggactatgtgcaccaggacctgagaaagttcttccctgcattggccgaagaagtgcaaattcacttggtcgaagctctgcccatcgtgttgaacatgtttgagaagaagcttagcagctacgcgcagtcacatttagaaaacacttccatcaaagtgcatctgagaaccgccgtcgccaaagttgaagaaaagcagttgttggccaagaccaaacacgaagacggtaaaataaccgaagaaaccattccatacggtactctgatttgggccaccggcaacaaggcaagaccggtaatcactgaccttttcaagaagattcctgagcaaaacagctccaagagaggattggcagtgaatgactttttgcaggtgaaaggcagcaacaacatcttcgccattggtgacaatgcatttgccgggctgccaccaaccgcccaagtagcgcaccaagaggccgaatatctggccaagaacttcgataagatggctcaaatcccaaatttccagaagaatctatcttcacggaaggataaaattgacctcttgttcgaggaaaacaacttcaaacctttcaagtacaacgatttaggcgccctggcatacctgggatccgaaagagccattgccaccatacgttccggtaagagaaccttctacaccggtggtggcttaatgaccttctacctgtggagaattttgtacctgagcatgattctaagcgccagatcgagattaaaggtctttttcgactggatcaaactggcctttttcaaaagagacttttttaaaggattatag

SEQ ID NO: 368 - DNA, 1542 bp, Artificial Sequence
  source: /note="Description of Artificial Sequence: Synthetic polynucleotide"
atgctatcgaagaacttgtacagcaacaagaggctgctcacctcgacgaatacgatggtccgcttcgcttccaccagatccacaggggtggaaaactccggagcaggccctacatcttttaagaccatgaaagtcatcgaccctcagcacagcgacaagccaaacgtgctgatactgggttctgggtggggagccatttcgtttttaaagcacattgacaccaagaagtacaacgtctccatcatcagccctagaaagtacttcttacacacgcctctgttaccctctgcaccagttggaaccgtagacgaaaagtcaattattgagcccatcgttaactttgccctcaagaaaaaggggaacgtcacctactatgaggcagaagccaccagcatcaaccccgaccggaataccgtgaccataaagtcattatctgccgttagccagctataccaacctgaaaaccatctagggctgcatcaagcagagcctgctgagattaagtacgactacttaatcagtgctgtgggcgcggagcctaacacatttggaatccccggcgtcactgattacggtcatttcctggaggaaattcccaacagcttggaaataagacggacttttgccgccaacctggaaaaggctaacctgttgccaaagggcgatcccgaacggagaaggctactgagcattgtcgtggttggcggtgggcctactggtgtggaggctgctggtgaactacaggattatgttcaccaggacctgagaaagtttctccctgcactggccgaggaagtgcagattcacttggtggaagctctgcccatcgttctgaatatgtttgagaaaaagctgtcatcatacgcgcaaagccatttagaaaacacctcgatcaaagtacacctgagaacggccgtcgccaaagttgaagaaaagcaattgctggcaaagaccaaacacgaggacggtaaaattaccgaggaaactattccatacggcactttgatttgggccacgggtaacaaggcaagaccggtaatcaccgaccttttcaagaaaattcctgagcagaacagcagcaagagaggcctggccgtgaacgactttttgcaggtcaaaggcagcaacaacattttcgccattggtgacaatgcctttgccggcttgccaccaacagcccaagtagcgcaccaagaggccgagtacttggccaagaactttgataaaatggctcagataccaaatttccaaaagaacctatcctcaagaaaggataaaattgatctcctgttcgaggagaacaactttaaacccttcaaatacaacgatttaggtgccttagcatacctgggaagcgaaagagccattgcaaccatacgttccggcaagagaaccttctacaccggtggaggcttaatgaccttctacctgtggcagattttgtacttgtccatgattctatctgcaagaagcagattaaaggtctttttcgactggattaagttagcatttttcaaaagggacttttttaaaggattatag

SEQ ID NO: 369 - DNA, 1542 bp, Artificial Sequence
  source: /note="Description of Artificial Sequence: Synthetic polynucleotide"
atgctgtcgaagaatttgtacagtaacaagaggctgctcacctcgaccaacacgctcgtgcgcttcgcttccaccagatccacaggcgtggaaaacagcggagcaggtcccacaagctttaagaccatgaaggtcattgaccctcagcacagcgacaaaccaaacgtgctgatactgggttctgggtggggagctattagctttttaaagcacattgacaccaagaagtacaacgtttccatcatcagccctagaaagtatttcctgtttacccctttgttaccttctgccccagtgggaacagtggacgagaagtcaatcattgagcccatcgttaattttgccctgaagaaaaagggcaacgtcacctactatgaggcagaagccacctctatcaatcccgacaggaataccgtgaccataaaaaacttatctgccgttagccagctataccaacctgagaaccatctagggctgcaccaggccgaacctgctgaaattaagtacgactatttaatcagtgccgtaggtgcggaacctaacacatttggtattcccggggtcaccgattacggccacttcctggaggaaattcccaactctctggaaataagaagaacttttgccgccaatctagaaaaggccaacctgttgcctaagggtgatcccgaaagaagaagactactgtccattgtcgtggttggtggtgggcctacaggcgtagaggctgctggtgagctacaggattatgttcaccaggacctgagaaagtttttccccgccctggccgaagaagtccaaattcacttggtcgaagctctgcccatcgttttgaatatgttcgagaagaagctttcatcatacgcgcaatcacatttagaaaacacttcgatcaaagtgcatctgagaacggctgtggccaaagttgaagaaaagcaattgttggccaagaccaagcacgaagacggcaaaataaccgaagaaactattccctacggtactttgatttgggccacgggtaacaaggcaagacccgtaatcaccgacctgttcaagaagattcctgagcaaaacagctccaagagaggattggccgtgaatgactttttgcaggtcaaaggcagcaacaacattttcgccattggcgacaatgcatttagcggcttgccaccaaccgcccaagtggcgcaccaggaggccgagtacttggccaagaattttgacaagatggctcaaataccaaatttccagaagaatctatcttcacggaaggataaaatcgacctcttgttcgaggagaacaacttcaaacccttcaaatacaacgatttaggcgccttagcctacctgggaagcgaaagggccattgccaccataagatccggtaagagaacattttacaccggtggtggcttaatgaccttctacttatggagaattttgtacttgagcatgatcctatctgccagatcgagactgaaggtgtttttcgactggatcaaactggcatttttcaagagggactttttcaagggactgtag

SEQ ID NO: 370 - DNA, 1542 bp, Artificial Sequence
  source: /note="Description of Artificial Sequence: Synthetic polynucleotide"
atgctatcgaagaacctgtatagtaacaagcggttgctgacctcgacgaatacgatggtcagattcgctagcaccagatccacaggggtggaaaactccggagcaggtcctacatctttcaagaccatgaaagtcattgaccctcagcacagcgacaagccaaacgtgctgatactgggctcggggtggggagctatttcgtttttaaagcacattgacaccaagaagtacaacgtcagcatcatctctcccagaaagtacttcttatttacgcctctgttacctagcgcaccagttgggaccgtggacgaaaagtcaattattgagcccatcgtgaattttgccctcaagaaaaaggggaacgtcacctactatgaggccgaagccacctctatcaaccccgacaggaacaccgtgaccatcaaatcattatctgccgttagccagctgtaccaacctgagaaccacctagggctgcaccaagcagagcctgccgaaattaagtacgactatttaatcagtgccgtaggtgcggagcccaacacatttggaatccccggcgtcaccgactacggtcatttcttcaaggaaatccccaactctttggaaatccggcggacttttgccgccaatctagaaaaggctaacttactgccaaagggtgatcccgaaagaagaagactgctgagcattgtggtcgtgggtggtgggcctacaggcgtggaggccgctggtgagctacaggactatgtgcaccaggacctgagaaagtttctgcccgcattggccgaggaagtccaaattcacttggtggaagctctgcccatcgttttgaatatgttcgagaaaaagctttcaagctacgcgcaaagccatttagaaaacacttcgatcaaagtacatctgagaaccgctgtcgccaaagttgaagaaaagcaattgttggccaagaccaagcacgaggacggcaaaattaccgaagaaactattccatacggcactttgatttgggccaccggtaacaaggcaagaccggtaatcactgacctgttcaagaagattcccgagcagaactcgagcaagagaggcttggcagtgaacgactttttgcaggtgaaaggcagcaacaacattttcgccattggcgacaatgcatttgccgggttgccaccaaccgcccaagtagcgcaccaagaggccgaatatctggccaagaattttgataaaatggctcagataccaaatttccaaaagaatctatcttccagaaaggataaaattgatctcttgttcgaggagaacaactttaagcctttcaagtacaacgatttaggcgccttagcatacctgggcagcgaaagggccattgcaaccatacgttccggtaagagaacattttacaccggtggtggcttaatgaccttctacttatggcagatcttgtacctgagcatgattctaagcgccagatcgagattaaaggtctttttcgactggattaagatggcattcttcaaaagagactttttcaagggactgtag

SEQ ID NO: 371 - DNA, 1542 bp, Artificial Sequence
  source: /note="Description of Artificial Sequence: Synthetic polynucleotide"
atgctatcgaagaatctgtatagtaacaagcggttgctcacctcgacgaataccctcgtgagattcgcttccaccagatccacaggggtggaaaactccggagctggccctacctctttcaagaccatgaaggtcattgacccccagcacagcgacaaaccaaacgtgctgatactgggttcggggtggggcgctatttcgtttttaaagcacatcgacaccaagaagtacaacgtctccatcatcagccctagaaagtatttcctgtttacgcccctgttaccctctgcacctgttgggacagtagacgagaagtcaattattgagcccatcgttaatttcgctctgaagaaaaagggcaacgttacctactatgaggccgaagccacctctatcaatcccgacaggaataccgtgaccatcaagtcactgagcgccgttagccagctataccaacctgaaaaccatctggggatgcaccaagcagaacctgctgaaattaagtacgattatttaatcagtgctgtaggcgccgaacctaacacatttggtattcctggggtcactgattacggtcatttcctgaaggaaattcccaactctttggaaataagaagaacctttgccgccaacctagaggaggctaacttattgccaaagggcgaccccgagagaagaagactactgtccatcgtcgtggttggcggtgggcctactggtgtggaggccgctggcgaactacaggattatgttcaccaggacctgagaaagtttctccctgccttggccgaggaagtccagattcacctggtcgaagctctgcccatcgttttgaatatgtttgagaaaaagctttcatcatacgcgcaatcacatctggaaaacacctcgatcaaagtacatctgagaacggccgtggccaaagttgaagaaaagcagttgctggcaaagaccaaacacgaagacggcaaaataaccgaggaaactattccatacggcaccttgatttgggccaccggtaacaaggcaagaccggtaatcactgaccttttcaagaagattcccgagcaaaactcgtccaagcggggcttggcagtgaatgacttcttgcaggtcaaaggcagcaacaacattttcgccattggcgacaatgcctttagcgggttgccaccaaccgcccaagtagcgcaccaggaggccgaatacctggccaagaattttgataaaatggcccaaatacccaatttccagaagaatctatcttcaagaaaggataaaatcgatctgctgttcgaggagaacaacttcaagcctttcaaatacaacgatctgggtgccttagcctacctgggatccgaaagggccattgccaccatcagatccggtaagagaacattttacaccggtggtggcctgatgaccttctacttatggcggatcttgtacctgagcatgattctgagcgcccgctcgagactgaaggtctttttcgactggattaagatggcattcttcaagagagacttctttaaaggcttatga

SEQ ID NO: 372 - DNA, 1542 bp, Artificial Sequence
  source: /note="Description of Artificial Sequence: Synthetic polynucleotide"
atgctatcgaagaatttgtacagtaacaagaggctgctcaccagcacgaacaccctagtcagattcgcttccaccagatccacaggggtggaaaacagcggagctggtcctacatcttttaagaccatgaaggtcattgaccctcagcacagcgacaagccaaacgtgctgatactgggttcggggtggggagctatttcgtttttaaagcacatcgacaccaagaagtacaacgtcagcatcatctctcctagaagctatttcttacacacgcctttgttacctagcgccccagttggaacagtagacgaaaagtccatcattgagcccatcgtgaacttcgccctcaagaaaaaggggaacgtcacctactatgaggcagaagccaccagcatcaaccccgaccggaataccgttaccataaaatcactgtctgccgttagccagctataccaacctgaaaaccatctagggctgcatcaagcagaacctgctgaaattaagtacgattatttaatcagcgctgtgggtgccgaacctaacacctttggtattcctggggtgactgactacggccatttcctggaggaaatccccaactctttggaaataagaagaacttttgccgccaatctggaggaggctaacttactgcctaagggtgaccccgaacggagaagactgctgagcattgtcgtcgttggtggaggccctacaggcgtagaggctgctggtgaactacaggattacgttcaccaggacctgagaaagtttctccccgcactggccgaggaagtccaaattcacctggtcgaagctctgcccatcgttctgaatatgttcgagaagaagcttagctcatacgcccaatcacacttagaaaacacttcgatcaaggtacatctgagaaccgctgtcgccaaagttgaagaaaagcagttgctggcaaagaccaaacacgaggacggtaaaataaccgaagaaactattccatacggcactttgatttgggccacgggcaacaaggcaagaccggtaatcactgaccttttcaagaaaattcctgagcagaactcgagcaagcggggactggcagtgaatgactttctgcaggtcaaaggcagcaacaacatcttcgccattggtgacaatgcatttgctggcttgccaccaacagcccaggtagcgcaccaggaggccgagtacatcgccaagaactttgataaaatggcccaaataccaaatttccaaaagaatctatcttcacggaaggataagatcgatctcttgttcgaggagaacaacttcaaacctttcaaatacaacgatttaggtgccttagcctacctgggatccgaaagagccattgcaaccatacgttccggtaagagaacattttacaccggtggtggcttaatgaccttctacctgtggagaattctgtacttgagcatgatcctgtctgcccgcagcagattaaaggtctttttcgactggattaagatggcctttttcaagagagacttttttaagggattatag

SEQ ID NO: 373 - DNA, 1542 bp, Artificial Sequence
  source: /note="Description of Artificial Sequence: Synthetic polynucleotide"
atgctatcgaagaatttgtacagtaacaagaggttgctcacctcgacgaacacgctagtcagattcgcttccaccagatccacaggggtcgaaaactccggagcaggtcctacatcttttaagaccatgaaagtcattgaccctcagcacagcgacaagcccaacgtgctgatactgggctcggggtggggagctatctcgtttttaaagcacattgacaccaagaagtacaacgttagcatcatcagccctagaaagtatttcttatttacgcccttgttacctagcgcaccagttgggacagtggacgaaaagtcaattatcgagcccatcgttaatttcgccctcaagaaaaaggggaacgttacctactatgaggcagaagccacctctatcaatcccgaccggaataccgttaccataaaaagcttaagcgccgtttcccagctgtaccagcctgaaaaccatctaggcctgcatcaagcagagcctgctgaaattaagtacgattacttaatcagtgctgtgggcgccgaacccaacacatttggaattcccggggtcaccgattacggccatttcttcgaggaaattcccaactctctggaaataagaagaacctttgccgccaacctagagaaggctaacctgctgcctaagggtgatcccgagagaagaagactactgagcattgtcgtggtgggtggtgggcctactggcgtagaggccgctggtgaactgcaggattacgttcaccaggacctgagaaagtttctgcctgccttggccgaggaagtccagattcacttggtcgaagccctgcccatcgttttgaatatgtttgagaaagagctttcatcatacgcccaatcacacctggaaaacacttcgatcaaggtacatctgagaacggctgtggccaaagtggaagaaaagcagttgttggcaaagaccaaacacgaggacggcaaaataaccgaggaaactattccatacggcactctgatttgggccacgggtaacaaggccagacccgtaatcactgacctgttcaagaagatccctgagcagaactcgtccaagcggggactggcagtgaacgactttttgcaggtcgagggcagcaacaacatcttcgccattggtgacaatgcctttgccgggctgccaccaaccgcccaagtagcgcaccaggaagccgaatatttggccaagaattttgacaaaatggctcagatcccaaatttccaaaagaatctatcctccagaaaggataaaattgatctcttgttcgaggagaacaactttaaacctttcaaatacaacgacctgggcgccttagcctacctgggaagcgaaagagccattgcaaccataagatccggcaagagaacattctacaccggtggtggcttaatgaccttctacttatggcggattttgtacttgagcatgattctatctgcaagaagcagattaaaggtctttttcgactggattaaattagcatttttcaaaagggactttttcaagggactgtga

SEQ ID NO: 374 - DNA, 1542 bp, Artificial Sequence
  source: /note="Description of Artificial Sequence: Synthetic polynucleotide"
atgctgtcgaagaatttgtatagtaacaagaggttgctgaccagcacgaataccctagtcagattcgcttccaccagatccaccggggtggaaaactccggagcaggtcctacaagctttaagaccatgaaagtcattgacccccagcacagcgacaagccaaacgtgctgatactgggttcggggtggggagctatttcgtttttaaagcacattgacaccaagaagtacaacgttagcatcatctctcccagaaagtatttcttatttacgcccttgttaccttctgccccagttgggacagtggacgaaaagtcaatcattgagcccatcgttaacttcgccctcaagaaaaagggcaacgttacctactatgaggcagaagccacctctatcaaccccgacaggaataccgtgaccatcaagagcttatctgccgtttcccagctataccaacctgaaaaccatctagggatgcaccaagccgagcccgccgaaattaagtacgattatttaatcagtgctgtaggtgcggagcccaacacatttggtatccctggcgtcaccgattacggccatttcctggaggagattcccaactctttggaaatcagaagaactttcgccgccaacctggaaaaggctaacttattgccaaagggtgatcccgaaagaagaagactactgtccattgtcgtcgttggtggtgggcctacaggtgtagaagctgctggcgagctacaggattacgtgcaccaggacctgagaaagttcttccccgcattggccgaagaagtccaaattcacttggtcgaagctctgcccatcgttttgaacatgtttgagaaaaagctttcaagctacgcccagtcacacttagaaaacacttcgatcaaggtacatctgagaacggctgtggccaaggttgaagagaagcaactgctggcaaagaccaagcacgaagacggtaaaataaccgaagaaactattccatacggtactctgatttgggccacgggtaacaaggcaagacccgtaatcactgaccttttcaagaaaattcctgagcaaaactcgagcaagagaggcctggcagtgaatgacttcttgcaggtgaaaggcagcaacaacattttcgccattggtgacaacgcatttgctggcctgccaccaaccgcccaagtagcgcaccaagaggccgaatatttggccaagaactttgataagatggctcaaatacccaatttccaaaagaatctatcttccagaaaggataaaatcgacctcttgttcgaggagaacaacttcaaacctttcaagtacaacgatttaggcgccctggcatacctgggaagcgaaagggccattgcaaccatccgttccggtaagagaaccttctacaccggcggtggcctgatgaccttctacctgtggcggattctgtacctgtccatgattctatctgcacgctcgagactgaaggtgttcttcgactggattaaattagcatttttcaagagagacttcttcaaaggcttatag

SEQ ID NO: 375 - DNA, 1542 bp, Artificial Sequence
  source: /note="Description of Artificial Sequence: Synthetic polynucleotide"
atgctatcgaagaatctgtacagtaacaagcggctgctcacctcgaccaatacgctcgtccgcttcgcttccaccagatccaccggggtggaaaactccggagcaggtcccacatctttcaagaccatgaaagtcatcgaccctcagcacagcgacaagccaaacgtgctgatactgggctcggggtggggagccatcagctttctgaagcacattgacaccaagaagtacaacgtttccatcatctctcctagaagctatttcttatttacgcccctgttaccttctgcaccagtggggacagtagacgaaaagtcaattattgagcccatcgttaacttcgctctcaagaaaaaggggaacgtcacctactatgaggccgaagccaccagcatcaaccccgaccggaataccgttaccatcaaaagcctgtctgccgttagccagctataccaacctgaaaaccatctagggatgcaccaagcagaacccgctgagattaagtacgattatttaatcagtgctgtaggcgcggaacccaacacatttggtatccctggcgtcactgattacggtcatttcttcgaggaaatccccaactctctggaaataagaagaacttttgccgccaatctagagaaggctaacttattgccaaagggtgaccccgaaagaagaagactactgtccattgtggtcgtgggcggtggccctactggtgtagaggccgctggtgagctgcaggattatgttcaccaggacctgcggaagttcctccctgcattggccgaagaagtccagattcacctggtcgaagctctgcccatcgttctgaacatgttcgagaagaagcttagcagctacgcgcaatcacacctggaaaacacttcgatcaaggtacacctgagaaccgccgtcgccaaggttgaagaaaagcagttgttggccaagaccaagcacgaagacggtaaaataaccgaagaaaccattccatacggcactctgatttgggccacgggtaacaaggcaagacccgtaatcactgaccttttcaagaaaattcccgagcaaaacagctccaagagaggcttggccgtgaatgactttttgcaggtcaaaggcagcaacaacattttcgccattggtgacaatgcatttagcgggctgccacctaccgcccaggtagcgcaccaagaggccgaatatctggccaagaattttgacaaaatggcccaaataccaaatttccaaaagaacctatcttcaagaaaggataaaattgacctcttgttcgaggagaacaacttcaagcctttcaagtacaacgatttaggtgccttagcatacctgggatccgaaagggccattgcaaccatcagatccggcaagagaacattttacaccggtggtggcttaatgaccttctacctgtggagaattttgtacttgagcatgattctaagcgcacgctcgagactgaaggtcttcttcgactggattaagatggcatttttcaaaagagactttttcaaaggattatga

SEQ ID NO: 376 - DNA, 1542 bp, Artificial Sequence
  source: /note="Description of Artificial Sequence: Synthetic polynucleotide"
atgctaagcaagaatttgtatagtaacaagaggctgctcacctcgacgaacacgatggtcagattcgcctccaccagatccaccggggtggaaaactccggggctggtcctaccagctttaagaccatgaaagtcattgaccctcagcacagcgacaaaccaaacgtgctgatcctgggctcggggtggggagctattagctttttaaagcacattgacaccaagaagtacaacgtttccatcatcagccctagaagctatttcctgtttacgcccttgttaccctctgcaccagttgggacagtagacgaaaagtccattatcgagcccatcgtgaattttgctctcaagaaaaaggggaacgtcacctactatgaggccgaagccacctctatcaaccccgacaggaacaccgttaccatcaagtcattatctgccgtgagccagctgtaccagcccgagaaccatctaggcctgcatcaggcagaacccgctgagattaagtacgattatttaatcagtgctgtaggcgcggagcctaacacatttggtattcctggcgtcaccgattacggccatttcctggaggaaattcccaactctttggaaatccggagaacctttgccgccaatctagaaaaggctaacctgctgccaaagggcgatcccgaaagaagaaggctactgtccattgtcgtcgttggtggagggcccactggtgtagaggccgctggtgaactgcaggattacgttcaccaggacctgcggaagttcttccccgcactggccgaggaagtgcaaattcacttggtcgaagctctgcccatcgttctgaacatgtttgagaaggagcttagctcatacgcgcaaagccatctggaaaacacttcgatcaaagtacatctgagaacggctgtcgccaaagttgaagaaaagcaattgttggcaaagaccaaacacgaagacggtaaaattaccgaggaaaccattccatacggcaccctgatttgggccacgggtaacaaggcaagacccgtaatcaccgaccttttcaagaaaatccctgagcaaaacagctccaagagaggactggccgtgaatgactttttgcaggtggagggcagcaacaacattttcgccatcggtgacaatgcatttgctgggttgccaccaaccgcccaggtagcgcaccaggaggccgaatatttggccaagaatttcgacaaaatggcccaaatcccaaatttccagaagaatctatcttcaagaaaggataaaattgatctcctgttcgaggaaaacaacttcaaacccttcaaatacaacgatttaggtgccttagcatacctgggatccgaaagagccattgcaaccatccgttccggtaagagaacattttacaccggcggtggcctgatgaccttctacttatggagaatcttgtacttgagcatgattctatctgcaagatcgagattaaaggtgtttttcgactggattaaattagcatttttcaaaagagacttcttcaaaggcttatag

SEQ ID NO: 377 - DNA, 1542 bp, Artificial Sequence
  source: /note="Description of Artificial Sequence: Synthetic polynucleotide"
atgctatcgaagaatttgtatagtaacaagcggttgctcaccagcacgaacaccctagtgagattcgcctccaccagatccacaggggtcgaaaactccggagcaggccccacatctttcaagaccatgaaagtcattgaccctcagcacagcgacaaaccaaacgtgctgatactgggctcgggctggggcgctattagctttctgaagcacattgacaccaagaagtacaacgtttccatcatctctcctagaagctatttcttacacacgcctttgctgccttctgccccagtggggacagtagacgaaaagtccattattgagcccatcgttaactttgctctcaagaaaaaggggaacgttacctactacgaggcagaagccacctctatcaatcccgacaggaacaccgttaccataaaaagcctgtctgccgttagccagctgtaccaacctgaaaaccatctagggctgcaccaagcagaacccgctgaaattaagtacgattatctgatcagtgctgtgggtgcggaacctaacacctttggtattcccggggtcactgattacggccatttcctgaaggaaattcccaactctctggaaatacggagaacctttgccgccaatctagaagaggctaacctgttgcctaagggcgatcccgaaagaagaagactgctgtccattgtcgtcgttggtggtgggcctactggcgtagaagccgctggcgaactgcaggactatgttcaccaggacctgagaaagtttttccccgcattggccgaggaagtccaaattcacttggtcgaagccctgcccatcgttttgaatatgtttgagaagaagcttagcagctacgcgcaaagccatctggaaaacacttcgatcaaagtacatctgagaaccgccgtcgccaaagttgaagaaaagcaattgctggcaaagaccaaacacgaagacggtaaaataaccgaggaaactattccatacggtaccttgatttgggccacgggtaacaaggcaagaccggtgatcaccgacctgttcaagaagatccccgagcaaaactcgagcaagagaggattggcagtgaatgactttctgcaggtgaaaggcagcaacaacattttcgccatcggtgacaatgcctttgccggcttgccaccaaccgcccaggtagcccaccaagaggccgagtatttggccaagaatttcgacaaaatggctcaaatacccaatttccagaagaacctatcttcaagaaaggataaaattgacctgctgttcgaggagaacaactttaaacccttcaagtacaacgatctgggtgccttagcctacctgggatccgaaagagccattgcaaccataagaagcggcaagcggacattttacaccggcggaggcttaatgaccttctacctgtggcagattttgtacatgtccatgattctatctgcccgctcgagattaaaggtctttttcgactggattaaattagcctttttcaaaagagacttttttaaaggattatga

SEQ ID NO: 378 - DNA, 1542 bp, Artificial Sequence
  source: /note="Description of Artificial Sequence: Synthetic polynucleotide"
atgctatcgaagaatttgtatagcaacaagaggttgctgaccagcacgaatacgctagtcagattcgcttccaccagatccacaggggtggaaaactccggagcaggtcctacatcttttaagaccatgaaagtcattgacccccagcacagcgacaaaccaaacgtgctgatactgggttcggggtggggagccatttcgtttttaaagcacattgacaccaagaagtacaacgtttccatcatctctcctagaaagtatttcctgttcacgcccttgttaccctctgcaccagtggggacagtagacgaaaagtcaattattgagcccatcgttaatttcgccctgaagaaaaaggggaacgtcacctactacgaggcagaagccaccagcatcaatcccgacaggaataccgttaccataaagtcattaagcgccgttagccagctgtaccaacctgagaaccatctaggcctgcatcaagcagaacctgctgaaattaagtacgactacttaatcagcgctgtgggtgccgaacctaacacctttggaattcccggcgtcactgattacggccacttcctgaaggaaattcccaactctttggaaatacggagaacttttgccgccaatctagaaaaggctaacttattgccaaagggtgatcccgaaagaagaaggctactgtccattgtcgtggttggtggtgggcctactggtgtagaggccgctggcgaactacaggactacgttcaccaggacctgcggaagttcttccccgcattggccgaagaagtgcaaattcacttggtggaagctctgcccatcgttctgaacatgtttgagaaagagctttcatcatacgcgcagagccatctggaaaacacttcgatcaaagtacatctgagaaccgctgtcgccaaagttgaagaaaagcaactgttggccaagaccaaacacgaggacggtaagataaccgaagaaactatcccatacggtaccctgatttgggccacgggcaacaaggccagaccggtgatcactgaccttttcaagaagattcccgagcaaaactcgagcaagcggggactggccgtgaatgactttttgcaggtggagggcagcaacaacattttcgccattggtgacaacgcctttgccgggttgccacctacagcccaagtagcccaccaggaggccgaatacatcgccaagaattttgataagatggctcagataccaaatttccaaaagaacctatcttcaagaaaggataagattgacctcttgttcgaggaaaacaacttcaaacctttcaagtacaacgatctgggtgccctggcctacctgggatccgaaagagccattgcaaccatccgttccggtaagcggaccttttacaccggtggtggcttaatgaccttctacttatggcggattttgtacttgtccatgattctgtctgccagaagcagattaaaggtgttcttcgactggattaagctggcattcttcaaaagagactttttcaaaggactgtag

SEQ ID NO: 379 - DNA, 1542 bp, Artificial Sequence
  source: /note="Description of Artificial Sequence: Synthetic polynucleotide"
atgctatcgaagaacctgtatagtaacaagaggttgctgacctcgacgaatacgctcgtcagattcgcctccaccagatccacaggggtggaaaactccggagcaggtcccacaagctttaagaccatgaaggtcattgaccctcagcacagcgacaaaccaaacgtgctgatcctgggttcgggctggggagctatttcgtttctgaagcacattgacaccaagaagtacaacgtttccatcatcagccctagaaagtacttcctgcacacgcctttgctgccctctgcccctgttgggacagtagacgaaaagtccattatcgagcccatcgttaattttgctctgaagaaaaagggcaacgttacctactacgaggccgaagccaccagcatcaaccccgacaggaacaccgtgaccatcaaatcattatctgccgtttcccagctataccagcccgaaaaccatctggggctgcatcaagccgaacctgccgaaattaagtacgattacctgatcagtgccgtaggtgccgaacctaacacatttggtatccccggggtcactgattacggccatttcctgaaagagattcccaactctttggaaatacggagaacctttgccgccaatctagagaaggctaacctgctgcctaagggtgatcccgaaagaagaaggctactgtccattgtcgtggttggtggtgggcccactggtgtggaggccgctggtgagctacaggattatgttcaccaggacctgcggaagtttctccccgccctggccgaagaagtccagattcacttggtcgaagccctgcccatcgtgctgaatatgttcgagaaaaagctttcaagctacgcccaatcacatctggaaaacacttcgatcaaagtacatctgagaacggctgtcgccaaagtggaagagaagcaattgttggcaaagaccaaacacgaagacggtaaaattaccgaagaaaccatcccatacggcactctgatttgggccacgggtaacaaggcaagaccggtaatcaccgacctgttcaagaaaattcctgagcaaaacagctccaagagaggactggcagtgaatgactttctgcaggtgaaaggcagcaacaacattttcgccattggtgacaatgcctttagcggcttgccaccaaccgcccaggtagcgcaccaagaggccgagtatatcgccaagaatttcgataaaatggctcaaatacccaatttccaaaagaatctatcttccagaaaggataagattgacctcttgttcgaggagaacaacttcaaacctttcaagtacaacgatttaggtgccttagcatacctgggaagcgaaagggccattgccaccatccgttccggcaagagaaccttttacaccggtggtggcttaatgaccttctacttatggagaatcctgtacttgtccatgattctatctgcaagatcgagattaaaggtgtttttcgactggattaagttagcctttttcaagagagacttttttgagggattatag

SEQ ID NO: 380 - DNA, 1542 bp, Artificial Sequence
  source: /note="Description of Artificial Sequence: Synthetic polynucleotide"
atgctgtcgaagaacctgtatagcaacaagaggttgctgacctcgacgaatacgatggtgagattcgcttccaccagatccacaggggtggaaaactccggagcaggtcccacatcttttaagaccatgaaggtcattgaccctcagcacagcgacaagccaaacgtgctgatactgggttctgggtggggagctatttcgtttttaaagcacattgacaccaagaagtacaacgtttccatcatctctcccagaagctatttcctgtttacgcccctgatgccttctgccccagttgggacagtagacgaaaagtcaattatcgagcccatcgttaattttgctctcaagaaaaaggggaacgttacctactatgaggcagaagccacctctatcaatcccgaccggaacaccgttaccatcaaatcactgtctgccgtttcccagctgtaccagcctgaaaaccacctagggatgcatcaagccgaacccgctgaaattaagtacgattacttaatcagtgctgtgggcgccgaacctaacacatttggtatccctggcgtcaccgactacggtcacttcctgaaggaaattcccaacagcttggaaatacggcggacttttgccgccaacctagagaaggctaacctgttgccaaagggtgaccccgaacggagaaggctgctgtccattgtcgtggttggtggagggcctactggcgtggaggccgctggcgagctacaggactatgtgcaccaggacctgagaaagtttctccctgcattggccgaagaagtgcaaattcacttggtcgaagccctgcccatcgttctgaatatgtttgagaaaaagctgtcaagctacgcccagtcacacttagaaaacacttcgatcaaagtacatctgagaacggctgtcgccaaggttgaagaaaagcagttgttggcaaagaccaagcacgaagacggtaaaataaccgaagaaactatcccatacggtaccctgatttgggccacgggtaacaaggcaagaccggtaatcaccgaccttttcaagaaaattcccgagcaaaacagcagcaagagaggattggcagtgaacgactttttgcaggtcaaaggcagcaacaacattttcgccatcggtgacaatgcatttagcgggttgcctccaaccgcccaagtggcgcaccaagaagccgaatatttggccaagaattttgataaaatggcccaaataccaaatttccagaagaatctatcttcaagaaaggataaaattgacctcttgttcgaggaaaacaacttcaagcccttcaaatacaacgacttaggtgccttagcctacctgggcagcgaaagggccattgcaaccatacgttccggtaagcggacattttacaccggcggaggcctgatgaccttctacctgtggcggatcttgtacatgtccatgattctaagcgcaagaagcagattaaaggtgttcttcgactggattaagttagcatttttcaagagagacttttttaaaggattatag

SEQ ID NO: 381 - DNA, 1542 bp, Artificial Sequence
  source: /note="Description of Artificial Sequence: Synthetic polynucleotide"
atgctgagcaagaatttgtatagtaacaagaggctgctcacctcgaccaatacgatggtccgcttcgcctccaccagatccacaggcgtggaaaactccggagctggtcctaccagcttcaagaccatgaaagtcattgaccctcagcacagcgacaaacccaacgtgctgatactgggttcggggtggggagccatctcgtttttaaagcacatcgacaccaagaagtacaacgtctccatcatctctcctagaaagtatttcttattcacgcctttgatgccttctgcacctgttgggacagtagacgaaaagtcaatcattgagcccatcgttaacttcgctctcaagaaaaagggcaacgttacctactatgaggcagaagccacctctatcaaccccgacaggaacaccgttaccataaaatcattatctgccgttagccagctataccaacctgaaaaccatctagggctgcaccaagccgaacctgccgaaattaagtacgattatctgatcagtgctgtgggtgccgagcctaacacatttggtattcccggcgtgaccgattacggtcatttcctgaaggaaattcccaactctctggaaatcagaagaacctttgccgccaatctggagaaggccaacttattgcctaagggcgatcccgaacggagaagactactgtccattgtggtggtgggtggagggcccactggtgtagaggccgctggtgagctacaggattacgtgcaccaggacctgagaaagtttctgcctgcattggccgaagaagtccaaattcacctggtcgaagctctgcccatcgttttgaatatgtttgagaagaagctttcaagctacgcgcaatcacatttagaaaacacttcgatcaaggtgcatctgagaacggctgtcgccaaagttgaagagaagcaactgttggcaaagaccaagcacgaggacggtaaaataaccgaagaaactattccatacggtactttgatttgggccacgggtaacaaggcaagaccggtgatcactgacctgttcaagaagatccccgagcaaaactcgtccaagagaggattggcagtgaacgactttttgcaggtggagggcagcaacaacattttcgccattggtgacaatgcatttgctggcctgccaccaaccgcccaagtagcgcaccaggaagccgagtatatcgccaagaactttgacaaaatggctcaaataccaaatttccaaaagaatctgtcttcacggaaggataaaatcgacctgctgttcgaggaaaacaactttaaacctttcaagtacaacgacttaggcgccttagcatacctgggcagcgaaagggccattgcaaccatcagaagcggtaagagaacattttacaccggtggaggcctgatgaccttctacctgtggcggatcttgtacttgagcatgatcctatctgcaagatcgagattaaaggtctttttcgactggattaaattagcctttttcaagagagacttcttcaaaggattatag

SEQ ID NO: 382 - DNA, 1542 bp, Artificial Sequence
  source: /note="Description of Artificial Sequence: Synthetic polynucleotide"
atgctgtcgaagaatttgtatagtaacaagcggctgctcacctcgaccaacacgctcgtccgcttcgcctccaccagatccacaggcgtcgaaaacagcggggcaggccccacaagcttcaagaccatgaaagtcatcgacccccagcacagcgacaaacccaacgtgctgatactgggctctgggtggggcgctattagctttctgaagcacatcgacaccaagaagtacaacgtctccatcatcagccccagaagctatttcctgtttacgcccctgttacccagcgcccctgtgggaacagtggacgagaagtcaattatcgagcccatcgttaattttgccctcaagaaaaagggcaacgtcacctactacgaggcagaagccacctctatcaatcccgacaggaacaccgtgaccataaagagcttaagcgccgtgagccagctgtaccaacctgagaaccacctggggctgcaccaggcagaacctgctgaaattaagtacgactacttaatcagcgccgtgggtgccgaacccaacacctttggaatccctggggtcactgactacggccacttcctgaaggaaattcccaactctttggaaatcagaagaactttcgccgccaacctagaaaaggccaacttattgcctaagggcgatcccgagagaagaaggctgctgagcattgtggtcgttggcggaggccccactggcgtagaggccgctggcgagctgcaggactacgtgcaccaggacctgagaaagtttctgcccgccttggccgaagaagtgcagattcacctggtggaagctctgcccatcgttctgaacatgttcgagaaggagcttagcagctacgcgcagagccatttagaaaacacttccatcaaagtacacctgagaaccgctgtggccaaggtggaagaaaagcagctgctggccaagaccaaacacgaggacggcaagataaccgaggaaactattccctacggcactttgatttgggccacgggcaacaaggcaagaccggtgatcactgaccttttcaagaagatccctgagcaaaacagcagcaagagaggcttggccgtgaacgactttctgcaggtgaaaggcagcaacaacatcttcgccatcggtgacaatgcatttgccggcttgcctccaacagcccaggtggcccaccaggaagccgaatacatcgccaagaacttcgataagatggcccagatccccaatttccagaagaacctatcctccagaaaggataagatcgacctgctgttcgaggagaacaactttaagcctttcaaatacaacgacttaggcgccctggcctacctgggcagcgaaagggccattgccaccatccgtagcggcaagcggacattctacaccggcggaggcctgatgaccttctacctgtggcggattctgtacatgtccatgattctaagcgcccgctcgagactgaaggtgttcttcgactggatcaagatggccttcttcaagagggacttcttcgagggcctgtag

SEQ ID NO: 383 - DNA, 1542 bp, Artificial Sequence
  source: /note="Description of Artificial Sequence: Synthetic polynucleotide"
atgctgtcgaagaatctgtacagcaacaagcggttgctgaccagcacgaatacgctcgtgagattcgccagcaccagatccaccggggtcgaaaacagcggggcaggccctaccagctttaagaccatgaaggtcattgacccccagcacagcgacaagcccaacgtgctgatactgggttctggctggggcgctatcagctttctgaagcacatcgacaccaagaagtacaacgtttccatcatctctcccagaagctacttcctgtttacccccttgctgcccagcgccccagttgggacagtagacgagaagtccatcatcgagcccatcgtgaattttgccctgaagaaaaaggggaacgtcacctactatgaggcagaggccaccagcatcaatcccgaccggaacaccgtgaccatcaagaacttatctgccgtgagccagctgtaccaacctgaaaaccacctgggcctgcaccaggccgaacctgccgaaattaagtacgactacttaatcagcgctgtgggtgccgagcctaacacatttggaatccccggggtgactgactacggtcatttcctgaaagaaatccccaactctttggaaataagaagaactttcgccgccaacctggaaaaggctaacttactgccaaagggcgaccccgaacggagaaggctgctgagcatcgtcgtggtgggcggtggccctacaggtgtggaagccgctggcgaactgcaggattatgttcaccaggacctgcggaagtttttccccgcactggccgaggaagtccagattcacctggtcgaagccctgcccatcgttttgaacatgttcgagaaggagctgagcagctacgcccaaagccacctggaaaacacctccatcaaggtgcacctgagaaccgccgtcgccaaggtggaagagaagcaactgttggccaagaccaaacacgaagacggcaaaataaccgaagaaactattccatacggtaccctgatttgggccacgggtaacaaggcaagacccgtgatcactgacctgttcaagaagattcccgagcagaactcgagcaagcggggcctggcagtgaacgacttcctgcaggtcaaaggcagcaacaacattttcgccattggtgacaacgcctttgccggcttgccacctacagcccaggtagcgcaccaggaagccgaatatctggccaagaactttgacaaaatggcccagataccaaatttccagaagaatctatcctcccggaaggataaaattgatctgctgttcgaggaaaacaacttcaagcccttcaagtacaacgacctgggcgccctggcctacctgggcagcgaaagagccattgcaaccataagaagcggcaagcggaccttctacaccggcggaggcctgatgaccttctacctgtggagaattttgtacctgtccatgatcctgagcgccagaagcagactgaaggtgttcttcgactggatcaaaatggcatttttcaaaagggacttctttgagggactgtga

SEQ ID NO: 384 - DNA, 1542 bp, Artificial Sequence
  source: /note="Description of Artificial Sequence: Synthetic polynucleotide"
atgctgagcaagaacttgtatagtaacaagaggctgctgaccagcaccaacacgatggtcagattcgcctccaccagatccaccggcgtcgaaaactccggagcaggccccaccagcttcaagaccatgaaggtcatcgacccccagcacagcgacaaaccaaacgtgctgatactgggttcggggtggggagctattagctttctgaagcacattgacaccaagaagtacaacgtcagcatcatcagccccagaagctatttcctgcacacccccttgctgcccagcgccccagtgggaacagtggacgagaagtccatcattgagcccatcgttaatttcgctctcaagaaaaaggggaacgttacctactacgaggccgaggccaccagcatcaaccccgaccggaataccgttaccataaaaaacttaagcgccgtgtcccagctgtaccagcccgaaaaccacctggggatgcaccaggcagagcccgccgaaattaagtacgattacctgatcagtgccgtaggtgcggaacccaacacatttggaatccccggcgtgaccgattacggccatttcctgaaagagatccccaactctctggaaatacggcggacttttgccgccaacctggaaaaggccaacctgctgcctaagggtgatcccgagcggagaaggctactgtccatcgtggtcgtgggcggaggccctacaggcgtagaagccgctggcgagctgcaggattacgtgcaccaggacctgcggaagttcctgcccgcattggccgaggaagtccagattcacctggtcgaagccctgcccatcgttctgaacatgttcgagaagaagctttcaagctacgcccaatcacacttagaaaacacctccatcaaggtacacctgagaaccgctgtggccaaggtggaagaaaagcagctgctggccaagaccaaacacgaagacggtaagataaccgaagaaaccattccatacggtactttgatttgggccacgggtaacaaggccagaccggtgatcaccgaccttttcaagaagatccccgagcaaaacagctccaagagaggcctggccgtgaacgactttttgcaggtcgagggcagcaacaacatcttcgccattggcgacaatgcatttgccggcctgccacctacagcccaggtagcgcaccaagaagccgaatacttggccaagaacttcgataaaatggctcagatccccaatttccagaagaatctgtcctcaagaaaggataagattgacctcttgttcgaggaaaacaactttaagcctttcaagtacaacgatctgggcgccttagcctacctgggatccgaaagggccattgcaaccatcagaagcggcaagcggaccttctacaccggcggtggcctgatgaccttctacttatggagaatcctgtacctgagcatgatcctgagcgcccgctcgagattaaaggtcttcttcgactggatcaagctggccttcttcaaaagggacttcttcaagggactgtag

SEQ ID NO: 385 - DNA, 1542 bp, Artificial Sequence
  source: /note="Description of Artificial Sequence: Synthetic polynucleotide"
atgctgagcaagaacctgtacagtaacaagcggctgctgacctcgaccaataccctcgtcagattcgcttccaccagatccacaggcgtcgaaaactccggagcaggccccacatcttttaagaccatgaaggtcatcgaccctcagcacagcgacaagccaaacgtgctgatcctgggctctggctggggcgccattagctttctgaagcacattgacaccaagaagtacaacgtcagcatcatctctcccagaagctatttcttatttacccccctgatgcccagcgcccctgttgggaccgtggacgaaaagtccatcatcgagcccatcgttaactttgccctcaagaaaaagggcaacgttacctactatgaggcagaagccacctctatcaaccccgaccggaacaccgtgaccatcaaaaacctgagcgccgtgtcccagctgtaccagcctgagaaccacctggggctgcaccaagcagagcctgccgagattaagtacgactacttaatcagtgctgtgggtgccgaacccaacacctttggtatccccggcgtcaccgattacggtcacttcttcaaggaaatccccaacagcttggaaatcagacggacctttgccgccaatctggaaaaggccaacctgctgcctaagggtgatcccgagagaagaagactgctgagcattgtcgtcgtgggtggaggccccacaggcgtggaggctgctggcgaactacaggactacgtgcaccaggacctgcggaagtttctgcccgccctggccgaagaagtgcagattcacttggtggaagctctgcccatcgtgttgaatatgttcgagaaagagcttagcagctacgcgcaaagccacttagaaaacacctccatcaaggtgcacctgagaaccgccgtggccaaggttgaagaaaagcaactgctggcaaagaccaaacacgaggacggtaagattaccgaagaaactatcccctacggcactctgatttgggccaccggtaacaaggcaagacccgtaatcaccgaccttttcaagaagatccctgagcagaacagcagcaagcggggcctggccgtgaacgacttcttgcaggtgaaaggcagcaacaacattttcgccatcggtgacaacgcctttgccgggctgccaccaacagcccaagtagcccaccaagaagccgagtatctggccaagaattttgacaagatggcccagatcccaaatttccaaaagaacctgtcctcaagaaaggataagattgacctgttgttcgaggagaacaacttcaagcctttcaagtacaacgacttaggcgccctggcctacctgggcagcgaaagggccattgccaccatcagaagcggcaagagaaccttttacaccggtggaggcttaatgaccttctacctgtggcggatcctgtacttgagcatgattctaagcgcccgcagcagactgaaggtgttcttcgactggattaaaatggcatttttcaaaagggactttttcaagggattatga

SEQ ID NO: 386 - DNA, 1542 bp, Artificial Sequence
  source: /note="Description of Artificial Sequence: Synthetic polynucleotide"
atgctgtcgaagaatctgtacagcaaccggaggttgctcacctcgaccaacaccctcgtccgcttcgccagcaccagatccaccggggtcgaaaacagcggggctggccccacaagctttaagaccatgaaggtcattgaccctcagcacagcgacaagccaaacgtgctgatactgggttcgggctggggagccattagctttttaaagcacatcgacaccaagaagtacaacgttagcatcatctctcccagaaagtacttcctgtttacgcccttgttacctagcgcccctgttggaacagtggacgagaagtcaatcattgagcccatcgtgaatttcgctctgaagaaaaagggcaacgtcacctactacgaggcagaggccacctctatcaaccccgaccggaacaccgtgaccatcaaaagcttaagcgccgtgtcccagctgtaccaacccgagaaccacctaggcctgcaccaagccgaacccgccgagattaagtacgattatttaatcagtgccgtgggtgcggaacccaacacatttggaatccctggggtgaccgactacggtcatttcctggaggagattcccaacagcctggaaatccggcggaccttcgccgccaacctggaaaaggctaacctgctgcctaagggcgaccccgagcggagaaggctgctgtccatcgtcgtcgtgggcggtggccctactggcgtagaagctgctggcgagctgcaggactatgtgcaccaggacctgagaaagttcttccccgcactggccgaggaagtccagattcacttggtggaagctctgcccatcgtgctgaatatgtttgagaaaaagctgagctcatacgcccagtcacatttagaaaacacctccatcaaagtacatctgagaaccgccgtggccaaggtggaagagaagcagctgttggcaaagaccaaacacgaggacggtaagataaccgaagaaactatcccctacggtaccttgatttgggccaccggcaacaaggcaagacccgtaatcaccgaccttttcaagaaaattcccgagcagaactcgagcaagagaggcctggccgtgaatgacttcctgcaggtgaaaggcagcaacaacatcttcgccatcggtgacaacgcatttgctggcctgccacctacagcccaagtagcccaccaagaggccgagtacctggccaagaactttgataaaatggcccagatccccaatttccagaagaacctgtcctcccggaaggataagatcgacctcctgttcgaggagaacaacttcaagcccttcaagtacaacgacttaggcgccctggcctacctgggaagcgaaagagccattgccaccatacgtagcggcaagagaaccttttacaccggtggtggcctgatgaccttctacctgtggcggattttgtacctgtccatgatcctaagcgcacgcagcagattaaaggtgttcttcgactggattaaactggcctttttcaagagggactttttcaaaggattatga

SEQ ID NO: 387 - DNA, 1542 bp, Artificial Sequence
  source: /note="Description of Artificial Sequence: Synthetic polynucleotide"
atgctatcgaagaacttgtacagtaaccggcggctgctcacctcgaccaataccctagtcagattcgcttccaccagatccacaggggtggaaaactccggggctggccctacctcttttaagaccatgaaggtcatcgacccccagcacagcgacaaacccaacgtgctgatcctgggctctggctggggcgccattagctttctgaagcacatcgacaccaagaagtacaacgtttccatcatcagccccagaagctatttcctgtttacccccctgatgcccagcgccccagttgggaccgtggacgagaagtcaatcatcgagcccatcgttaacttcgccctgaagaaaaagggcaacgtcacctactacgaggcagaggccaccagcatcaaccccgacaggaataccgtgaccatcaagtcattatctgccgtgtcccagctgtaccagcccgagaaccatctagggctgcaccaggcagagcccgccgaaattaagtacgattacctgatcagtgctgtgggcgcggaacccaacacatttggtatccctggcgtgaccgactacggtcacttcctgaaagaaatccccaactctttggaaataagacggaccttcgccgccaacctggaagaggctaacctgctgcctaagggcgatcccgaaagaagaagactgctgagcatcgtggtcgttggcggtggccctactggtgtagaagctgctggcgagctacaggattatgttcaccaggacctgcggaagtttctgcccgcattggccgaagaagtgcagattcacttggtggaagccctgcccatcgtgctgaacatgtttgagaagaagctgagctcatacgcgcagagccatttagaaaacacctccatcaaagtgcatctgagaaccgccgtggccaaggtggaagagaagcagctgctggccaagaccaagcacgaagacggcaaaattaccgaggaaaccatcccctacggtaccttgatttgggccacgggtaacaaggccagacccgtgatcaccgacctgttcaagaaaattcctgagcagaactcgagcaagagaggcctggcagtgaacgacttcctgcaggtgaaaggcagcaacaacatcttcgccatcggtgacaatgcctttagcggcctgcctcctacagcccaggtggcccaccaggaagccgaatatttggccaagaatttcgataagatggcccagatacccaatttccaaaagaacctatcctcccggaaggataagatcgacctgttgttcgaggaaaacaacttcaagcctttcaaatacaacgacctgggcgccttagcctacctgggaagcgaaagggccattgccaccatacgtagcggcaagcggaccttctacaccggtggaggcttaatgaccttctacctgtggcggatcttgtacttgagcatgatcctgtctgcaagaagcagattaaaggtcttcttcgactggatcaaactggcatttttcaaaagggacttttttgagggcctgtga

SEQ ID NO: 388 - DNA, 1542 bp, Artificial Sequence
  source: /note="Description of Artificial Sequence: Synthetic polynucleotide"
atgctgagcaagaatttgtacagcaacaagcggttgctcaccagcacgaacacgctagtcagattcgctagcaccagatccaccggcgtggaaaacagcggggctggtcctacctctttcaagaccatgaaagtcatcgacccccagcacagcgacaaacccaacgtgctgatcctgggttcgggctggggcgccatcagctttctgaagcacatcgacaccaagaagtacaacgtctccatcatcagccccagaagctacttcttacacacccccttgctgcccagcgccccagtgggaaccgtagacgaaaagtcaattatcgagcccatcgtgaatttcgctctgaagaaaaagggcaacgtcacctactatgaggcagaagccaccagcatcaatcccgaccggaataccgttaccatcaagagcctgtctgccgtgagccagctgtaccagcctgaaaaccacctaggcctgcaccaggcagagcccgctgaaattaagtacgattatttaatcagcgccgtgggcgcggagcccaacacctttggaatccccggggtgaccgactacggccacttcttcaaagagattcccaactctttggaaatccggagaactttcgccgccaacctagagaaggctaacttattgcctaagggtgaccccgagcggagaagactactgagcattgtggtcgtgggcggaggccccactggcgtagaagctgctggcgaactgcaggattacgtgcaccaggacctgcggaagtttttccccgccctggccgaggaagtccagattcacctggtcgaagccctgcccatcgttctgaacatgttcgagaaggagctgtcatcatacgcgcagtcacatttagaaaacacctccatcaaagtacatctgagaaccgctgtggccaaagttgaagagaagcagctgttggcaaagaccaagcacgaggacggcaaaattaccgaggaaaccatcccatacggcactctgatttgggccacgggcaacaaggccagacccgtaatcactgacctgttcaagaagattcctgagcaaaactcgtccaagcggggactggccgtgaatgacttcctgcaggtgaaaggcagcaacaacattttcgccattggtgacaacgcctttagcggcctgcctccaacagcccaggtagcccaccaggaagccgaatatctggccaagaacttcgacaagatggcccagatcccaaatttccagaagaatctgtcttcaagaaaggataaaatcgatctcttgttcgaggaaaacaacttcaagcctttcaagtacaacgacttaggcgccctggcatacctgggctccgaaagggccattgccaccatcagaagcggcaagcggaccttctacaccggtggaggcctgatgaccttctacctgtggcggattctgtacctgagcatgatcctgagcgcacgcagcagactgaaggtgttcttcgactggattaagctggcattcttcaagagagacttctttaaaggactgtag

SEQ ID NO: 389 - DNA, 1542 bp, Artificial Sequence
  source: /note="Description of Artificial Sequence: Synthetic polynucleotide"
atgctgagcaagaacttgtacagcaaccggcggctgctgacctcgaccaatacgatggtgcgcttcgccagcaccagatccaccggcgtggaaaactccggggctggccctaccagctttaagaccatgaaggtcatcgaccctcagcacagcgacaagcccaacgtgctgatcctgggttcgggctggggagctatcagctttctgaagcacatcgacaccaagaagtacaacgtctccatcatctctcccagaagctacttcttatttacccccctgatgccctctgccccagtgggaaccgtggacgagaagtcaattatcgagcccatcgtgaactttgctctcaagaaaaaggggaacgtcacctactacgaggccgaggccaccagcatcaatcccgaccggaacaccgttaccataaagtcactgtctgccgttagccagctgtaccagcccgaaaaccacctggggctgcatcaagccgagcctgccgagattaagtacgattacctgatcagcgccgtaggtgcggagcccaacacatttggaattcccggggtgaccgactacggtcacttcctgaaagagattcccaacagcctggaaatacggagaactttcgccgccaatctagaaaaggctaacttactgcctaagggtgaccccgagagaagaaggctgctgtccatcgtcgtcgtgggcggaggccctactggtgtagaggctgctggtgaactacaggattacgtgcaccaggacctgagaaagttcttccccgccttggccgaagaagtccagattcacctggtggaagctctgcccatcgtgctgaacatgtttgagaaaaagctgagcagctacgcccaatcacatttagaaaacacctccatcaaggtgcacctgagaaccgccgtcgccaaggtggaagaaaagcaattgttggcaaagaccaaacacgaggacggcaagattaccgaagaaaccattccatacggcaccttgatttgggccaccggcaacaaggccagacccgtaatcaccgacctgttcaagaagattcccgagcaaaacagctccaagcggggcctggcagtgaacgactttttgcaggtgaaaggcagcaacaacatcttcgccatcggcgacaacgcctttgccggcttgcctccaacagcccaagtggcccaccaagaggccgagtacttggccaagaacttcgataaaatggctcaaatcccaaatttccagaagaacctgtcttcacggaaggataaaatcgatctgctgttcgaggagaacaactttaagcccttcaagtacaacgacctgggtgccctggcctacctgggctccgaaagagccattgccaccatcagatccggcaagagaaccttctacaccggcggtggcctgatgaccttctacttatggcggatcttgtacctgagcatgatcctgtctgcccgcagcagattaaaggtgttcttcgactggatcaaaatggcctttttcaaaagagacttctttaagggcctgtag

SEQ ID NO: 390 - DNA, 1542 bp, Artificial Sequence
  source: /note="Description of Artificial Sequence: Synthetic polynucleotide"
atgctgagcaagaatctgtacagcaaccggcggctgctgacctcgaccaataccctcgtgcgcttcgccagcaccagatccaccggcgtcgaaaacagcggagctggccccaccagcttcaagaccatgaaggtcatcgacccccagcacagcgacaaacccaacgtgctgatactgggttctggctggggcgccatctcgtttctgaagcacattgacaccaagaagtacaacgttagcatcatcagccccagaaagtacttcctgttcacgcctctgatgcccagcgcacctgtgggaaccgtagacgagaagtcaattatcgagcccatcgttaacttcgccctgaagaaaaagggcaacgtcacctactatgaggccgaagccacctctatcaaccccgacaggaataccgtgaccatcaagtcattatctgccgttagccagctataccagcctgagaaccacctgggcctgcaccaggccgagcccgctgagattaagtacgactacctgatcagtgctgtaggtgccgagcctaacacctttggaattcccggggtgactgattacggtcacttcctgaaagagatccccaacagcctggaaatacggcggaccttcgccgccaacctggagaaggctaacctgctgcctaagggtgaccccgaaagaagaagactgctgtccatcgtcgtggtgggtggtggccccacaggtgtggaggccgctggtgagctgcaggattacgttcaccaggacctgagaaagtttctgcccgccttggccgaagaagtccaaattcacctggtggaagctctgcccatcgttctgaacatgttcgagaagaagctgagctcatacgcgcaatcacatctggaaaacacttccatcaaggtacacctgagaaccgccgtggccaaagtggaagaaaagcagctgttggccaagaccaagcacgaggacggtaagattaccgaggaaactattccctacggcaccttgatttgggccaccggtaacaaggcaagacccgtgatcaccgaccttttcaagaaaatccccgagcagaactcgagcaagagaggcctggccgtgaacgactttttgcaggtcaaaggcagcaacaacattttcgccatcggcgacaatgcatttgccggcttgcctccaaccgcccaggtggcccaccaggaagccgaatacctggccaagaacttcgataagatggctcagatcccaaatttccagaagaatctgtcttcccggaaggataaaatcgacctcttgttcgaggaaaacaactttaagcctttcaaatacaacgacctgggcgccttagcctacctgggaagcgaaagggccattgcaaccatccgttccggtaagagaacattttacaccggtggaggcctgatgaccttctacctgtggcagatcttgtacctgtccatgattctgtctgcccgcagcagactgaaggtgtttttcgactggatcaaaatggcattcttcaagagggactttttcaagggactgtga

SEQ ID NO: 391 - DNA, 1542 bp, Artificial Sequence
  source: /note="Description of Artificial Sequence: Synthetic polynucleotide"
atgctatcgaagaacttgtacagtaacaagcggctgctgacctcgaccaacaccatggtccgcttcgccagcaccagatccacaggcgtggaaaacagcggagctggccccaccagcttcaagaccatgaaagtcatcgacccccagcacagcgacaagccaaacgtgctgatcctgggctcggggtggggcgctattagctttttaaagcacattgacaccaagaagtacaacgtcagcatcatctctcccagaagctatttcttattcacgcccctgttaccttctgcaccagtgggaaccgtagacgaaaagtcaatcatcgagcccatcgtgaacttcgccctgaagaaaaaggggaacgttacctactacgaggccgaggccaccagcatcaaccccgacaggaacaccgtgaccatcaaaagcttatctgccgtttcccagctataccaacccgaaaaccatctgggcctgcaccaggcagagcctgccgagattaagtacgactatctgatcagcgccgtgggcgccgaacccaacacctttggaatccccggcgtcactgattacggtcacttcctggaggagatccccaactctctggaaatcagacggaccttcgccgccaatctggaagaggccaacttactgccaaagggcgaccccgagcggagaaggctgctgagcattgtggtggttggcggtggccccacaggcgtggaagctgctggtgagctacaggactatgtgcaccaggacctgcggaagtttttccccgccctggccgaggaagtccaaattcacctggtggaagctctgcccatcgtgttgaatatgttcgagaagaagctttcatcatacgcgcagtcacacctggaaaacacctccatcaaggtacacctgagaaccgctgtcgccaaggttgaagagaagcaactgctggcaaagaccaaacacgaagacggcaagataaccgaggaaaccattccctacggtactctgatttgggccaccggcaacaaggccagacccgtaatcactgaccttttcaagaagatccctgagcaaaacagctccaagagaggcttggccgtgaacgacttcctgcaggtcaaaggcagcaacaacatcttcgccattggtgacaacgcctttgctggcctgcctcctaccgcccaggtggcccaccaagaggccgaatacctggccaagaactttgataagatggctcaaatccccaatttccagaagaacctgtcttcaagaaaggataagattgatctcctgttcgaggagaacaactttaagcccttcaaatacaacgacttaggcgccttagcctacctgggctccgaaagggccattgccaccatccgtagcggcaagagaacattctacaccggcggaggcttaatgaccttctacctgtggagaattttgtacctgagcatgattctgagcgcccgcagcagattaaaggtctttttcgactggatcaagctggcatttttcaagagggacttcttcgagggcctgtga

SEQ ID NO: 392 - DNA, 1542 bp, Artificial Sequence
  source: /note="Description of Artificial Sequence: Synthetic polynucleotide"
atgctgagcaagaacttgtacagcaacaagcggctgctcacctcgaccaataccatggtcagattcgcctccaccagatccaccggcgtggaaaactccggagctggccccacatctttcaagaccatgaaggtcattgacccccagcacagcgacaagccaaacgtgctgatcctgggctcggggtggggagctattagctttttaaagcacatcgacaccaagaagtacaacgtcagcatcatctctcccagaagctacttcctgtttacccccctgctgcccagcgcccctgtgggaacagtggacgagaagtccattatcgagcccatcgtgaattttgccctcaagaaaaagggcaacgtcacctactatgaggccgaggccacctctatcaaccccgaccggaataccgtgaccatcaagaacctgtctgccgtttcccagctataccagcctgagaaccatctgggcctgcaccaggccgagcccgctgagattaagtacgactacctgatcagtgccgtgggtgccgaacctaacacatttggaattcctggcgtgactgactacggtcatttcctggaggagatccccaacagcctggaaatccggagaaccttcgccgccaatctggaaaaggccaacctgctgcctaagggcgatcccgaacggagaagactgctgtccattgtggtggtgggtggaggccctacaggcgtagaagctgctggcgagctgcaggattacgtgcaccaggacctgcggaagttcctgcctgcactggccgaagaagtccagattcacttggtggaagctctgcccatcgttttgaacatgttcgagaaaaagctgtcaagctacgcccagagccatttagaaaacacttcgatcaaagtacacctgagaaccgctgtcgccaaggttgaagagaagcaactgttggccaagaccaagcacgaggacggtaagattaccgaggaaactatcccctacggcactttgatttgggccacgggcaacaaggccagacccgtaatcaccgacctgttcaagaagatccccgagcagaacagcagcaagagaggattggcagtgaacgactttctgcaggtgaaaggcagcaacaacattttcgccattggtgacaacgcctttgctggcctgccacctacagcccaagtggcgcaccaggaagccgaatacctggccaagaatttcgacaagatggctcaaataccaaatttccaaaagaacctgtcctcccggaaggataagatcgacctcttgttcgaggaaaacaacttcaagcccttcaaatacaacgacctgggcgccctggcatacctgggctccgaaagggccattgccaccatacgttccggcaagagaaccttctacaccggcggaggcttaatgaccttctacttatggagaattctgtacctgagcatgatcctaagcgccagaagcagattaaaggtgtttttcgactggatcaagatggcctttttcaaaagggacttctttgagggcctgtga

SEQ ID NO: 393 - DNA, 1542 bp, Artificial Sequence
  source: /note="Description of Artificial Sequence: Synthetic polynucleotide"
atgctgtcgaagaacctgtacagtaacaagcggttgctgacctcgacgaacaccctcgtcagattcgccagcaccagatccacaggcgtcgaaaactccggggcaggccccacctctttcaagaccatgaaagtcatcgacccccagcacagcgacaaacccaacgtgctgatcctgggctctgggtggggcgccattagctttctgaagcacatcgacaccaagaagtacaacgtctccatcatcagccctagaaagtacttcctgttcacccctttgctgccctctgcaccagtggggaccgtggacgagaagtccatcatcgagcccatcgttaatttcgccctgaagaaaaagggcaacgttacctactatgaggcagaggccaccagcatcaatcccgaccggaacaccgttaccatcaaaaacctgagcgccgtttcccagctataccagcctgagaaccacctaggcctgcatcaggccgaacctgccgagattaagtacgattatctgatcagtgctgtgggcgccgagcccaacacatttggtatccccggcgtcaccgactacggtcacttcttcaaggagattcccaactctctggaaatacggagaaccttcgccgccaacctggagaaggctaacttactgcctaagggcgaccccgagcggagaagactactgtccatcgtggtcgtgggcggaggccccactggtgtggaagctgctggtgagctgcaggactatgttcaccaggacctgagaaagttcctgcccgccctggccgaagaagtgcagattcacctggtggaagccctgcccatcgtgctgaacatgttcgagaagaagctgagcagctacgcccagtcacatttagaaaacacctccatcaaggtacatctgagaacggccgtcgccaaggtggaagaaaagcagttgttggccaagaccaaacacgaagacggtaagattaccgaggaaactatcccatacggcaccctgatttgggccaccggcaacaaggccagacccgtaatcactgacctgttcaagaaaattcccgagcagaacagctccaagcggggcctggccgtgaacgacttcctgcaggtgaaaggcagcaacaacattttcgccattggtgacaacgcctttagcgggttgcctcctaccgcccaagtggcgcaccaagaagccgagtatttggccaagaacttcgataaaatggctcagatcccaaatttccaaaagaacctgtcctccagaaaggataagattgacctcctgttcgaggagaacaactttaaacctttcaagtacaacgatctgggtgccctggcctacctgggatccgaaagagccattgcaaccatcagatccggcaagcggaccttctacaccggcggtggcttaatgaccttctacttatggagaatcctgtacctgtccatgatcctgtctgcccgcagcagactgaaggtcttcttcgactggatcaaaatggcctttttcaaaagggacttttttaagggattatga

SEQ ID NO: 394 - DNA, 1542 bp, Artificial Sequence
  source: /note="Description of Artificial Sequence: Synthetic polynucleotide"
atgctgagcaagaatttgtatagcaacaagaggctgctcaccagcaccaataccatggtgcgcttcgcttccaccagatccacaggggtggaaaacagcggagcaggccccacaagcttcaagaccatgaaggtcatcgacccccagcacagcgacaagccaaacgtgctgatactgggctctggctggggcgccattagctttctgaagcacatcgacaccaagaagtacaacgtcagcatcatctctcctagaagctatttcctgttcacccccctgctgcccagcgcaccagttggaacagtagacgaaaagtccatcattgagcccatcgtgaatttcgccctcaagaaaaagggcaacgtcacctactacgaggccgaagccaccagcatcaatcccgacaggaacaccgttaccataaagtcactgtctgccgttagccagctgtaccagcccgagaaccatctggggctgcaccaagccgagcctgccgagattaagtacgactacttaatcagcgccgtaggcgccgaacctaacacatttggaatccctggggtgaccgattacggccacttcctgaaggaaattcccaacagcctggaaataagaagaacttttgccgccaacctggaggaggctaacctgctgcctaagggcgaccccgagagaagaaggctactgagcatcgtggtggtgggtggagggcccactggcgtggaggccgctggcgagctacaggactacgttcaccaggacctgcggaagttcctccccgcactggccgaggaagtccagattcacctggtcgaagctctgcccatcgttctgaacatgttcgagaagaagcttagctcatacgcccagagccatctggaaaacacctcgatcaaagtgcacctgagaacggccgtcgccaaggtggaagagaagcaactgttggccaagaccaaacacgaggacggtaaaattaccgaggaaactatcccctacggcaccttgatttgggccaccggtaacaaggccagacccgtaatcactgaccttttcaagaagattcccgagcagaactcgagcaagcggggcctggccgtgaatgacttcctgcaggtcaaaggcagcaacaacatcttcgccattggtgacaacgcatttgccggcctgcctcctacagcccaggtagcccaccaggaggccgaatacatcgccaagaattttgataaaatggctcagataccaaatttccagaagaacctgtcttcccggaaggataaaattgacctgttgttcgaggaaaacaacttcaagcccttcaagtacaacgacctgggtgccttagcatacctgggctccgaaagagccattgccaccatcagatccggcaagcggaccttctacaccggtggaggcctgatgaccttctacctgtggcagatcctgtacatgagcatgatcctgagcgcacgcagcagactgaaggtgtttttcgactggatcaaactggccttcttcaaaagggactttttcaagggcctgtag

SEQ ID NO: 395 - DNA, 1542 bp, Artificial Sequence
  source: /note="Description of Artificial Sequence: Synthetic polynucleotide"
atgctgagcaagaacttgtatagcaacaagaggttgctgacctcgacgaacaccatggtgagattcgccagcaccagatccaccggggtggaaaactccggggcaggtcccacaagcttcaagaccatgaaggtcattgacccccagcacagcgacaaaccaaacgtgctgatcctgggttcgggctggggcgccatttcgtttctgaagcacattgacaccaagaagtacaacgtctccatcatcagccccagaagctacttcctgtttacgcccttgctgccctctgcccctgttgggaccgtggacgaaaagtccatcattgagcccatcgttaactttgccctcaagaaaaagggcaacgttacctactacgaggcagaggccaccagcatcaaccccgaccggaacaccgtgaccataaaaagcttaagcgccgtgagccagctataccagcccgagaaccatctgggcctgcaccaggccgagcccgctgaaattaagtacgattatctgatcagtgctgtgggtgccgaacctaacacctttggaatccccggcgtgaccgactacggccacttcctgaaggagattcccaactctctggaaatccggcggacctttgccgccaacctagaaaaggctaacttactgccaaagggtgaccccgagcggagaagactactgagcattgtggtcgtgggtggagggcccacaggtgtggaggccgctggtgagctacaggattatgtgcaccaggacctgagaaagttcttccccgccttggccgaggaagtccaaattcacctggtggaagctctgcccatcgtgctgaacatgttcgagaaggagctttcatcatacgcccaatcacatctggaaaacacctcgatcaaagtacacctgagaaccgccgtggccaaggtggaagaaaagcagctgttggccaagaccaagcacgaggacggtaagattaccgaggaaactatcccatacggcaccttgatttgggccacgggcaacaaggccagaccggtaatcaccgaccttttcaagaagattcctgagcagaacagcagcaagcggggcctggcagtgaacgacttcttgcaggtcaaaggcagcaacaacattttcgccatcggcgacaatgcctttgctggcctgccacctaccgcccaggtggcccaccaggaagccgaatacctggccaagaacttcgataagatggctcagatccccaatttccagaagaacctgtcctcccggaaggataagatcgatctgctgttcgaggaaaacaactttaagcctttcaaatacaacgatctgggtgccctggcctacctgggaagcgaaagagccattgcaaccatccgtagcggtaagcggacattctacaccggtggaggcctgatgaccttctacctgtggcagatcttgtacttgagcatgattctatctgcccgctcgagactgaaggtgttcttcgactggatcaagctggccttcttcaagagagacttcttcgagggcttatag

SEQ ID NO: 396 - DNA, 1542 bp, Artificial Sequence
  source: /note="Description of Artificial Sequence: Synthetic polynucleotide"
atgctatcgaagaatctgtacagcaacaagcggttgctcaccagcaccaatacgctcgtccgcttcgctagcaccagatccacaggggtggaaaacagcggagcaggtcctacatctttcaagaccatgaaggtcattgaccctcagcacagcgacaagcccaacgtgctgatcctgggctctggctggggagccatctcgtttctgaagcacatcgacaccaagaagtacaacgtcagcatcatctctcccagaagctacttcttacacacccccttgttacccagcgccccagttgggaccgtggacgagaagtcaatcatcgagcccatcgttaacttcgctctgaagaaaaaggggaacgtcacctactatgaggccgaggccaccagcatcaaccccgaccggaataccgtgaccataaaatcactgagcgccgtttcccagctataccagcccgagaaccacctagggctgcaccaggccgagcccgccgaaattaagtacgactatttaatcagtgccgtaggtgccgaacccaacacatttggtattcccggcgtcactgattacggtcacttcctgaaagaaatccccaacagcttggaaatacggagaaccttcgccgccaacctggaaaaggctaacctgttgcctaagggtgatcccgagagaagaaggctgctgagcatcgtggtcgtgggcggagggcctactggcgtagaagccgctggtgagctacaggactacgtgcaccaggacctgcggaagtttctgcccgcactggccgaagaagtgcaaattcacttggtggaagccctgcccatcgtgttgaatatgttcgagaagaagctttcaagctacgcccagagccacctggaaaacacctccatcaaggtacacctgagaaccgccgtcgccaaagtggaagagaagcagttgctggcaaagaccaagcacgaggacggcaaaattaccgaagaaactatcccctacggtaccctgatttgggccaccggcaacaaggccagacccgtgatcaccgacctgttcaagaagatccccgagcagaacagcagcaagcggggattggcagtgaacgacttcttgcaggtcgagggcagcaacaacatcttcgccatcggtgacaacgcctttgccggcctgccaccaaccgcccaagtagcccaccaggaggccgaatatttggccaagaatttcgacaagatggcccagatcccaaatttccagaagaacctgtcctcccggaaggataagatcgacctgctgttcgaggagaacaactttaaacccttcaaatacaacgacttaggtgccctggcctacctgggcagcgaaagagccattgccaccatccgtagcggtaagagaacattctacaccggcggtggcctgatgaccttctacctgtggcagatcctgtacatgagcatgatcctaagcgcaagaagcagactgaaggtgttcttcgactggattaaattagcctttttcaaaagggactttttcgagggcttatga

SEQ ID NO: 397 - DNA, 1542 bp, Artificial Sequence
  source: /note="Description of Artificial Sequence: Synthetic polynucleotide"
atgctatcgaagaacttgtacagtaacaagaggctgctcacctcgacgaacacgatggtccgcttcgctagcaccagatccaccggcgtggaaaactccggagctggccctacaagctttaagaccatgaaagtcatcgacccccagcacagcgacaaaccaaacgtgctgatactgggctctgggtggggagccatttcgtttctgaagcacatcgacaccaagaagtacaacgttagcatcatctctcccagaaagtacttcctgttcacccccctgctgccctctgcccctgtggggacagtggacgaaaagtcaattattgagcccatcgttaactttgctctgaagaaaaaggggaacgtcacctactatgaggcagaggccacctctatcaaccccgacaggaataccgtgaccataaaaagcttaagcgccgtgtcccagctgtaccagcctgagaaccatctggggctgcaccaggccgaacccgctgagattaagtacgattatttaatcagtgccgtgggtgccgagcccaacacctttggtattcctggcgtgaccgactacggtcatttcctgaaagaaatccccaactctttggaaatccggcggacctttgccgccaacctagaaaaggccaacctgctgccaaagggtgaccccgagagaagaaggctgctgagcatcgtggtcgtgggcggagggcctacaggtgtggaggctgctggcgaactgcaggactacgtgcaccaggacctgcggaagtttttccccgccctggccgaagaagtccaaattcacctggtggaagctctgcccatcgtgttgaacatgtttgagaaggagctgagcagctacgcgcagagccacttagaaaacacctccatcaaggtgcacctgagaaccgctgtggccaaggtggaagagaagcagctgttggccaagaccaagcacgaggacggtaagattaccgaggaaactattccatacggcaccctgatttgggccaccggcaacaaggcaagaccggtgatcaccgacctgttcaagaaaattcctgagcagaacagcagcaagcggggcttggccgtgaacgacttcctgcaggtcaaaggcagcaacaacattttcgccatcggcgacaatgcatttgccggcctgccaccaacagcccaggtggcccaccaagaagccgagtatctggccaagaacttcgataagatggcccagatcccaaatttccaaaagaacctgtcttcacggaaggataagatcgacctgctgttcgaggaaaacaactttaaacccttcaaatacaacgatctgggcgccctggcatacctgggcagcgaaagggccattgcaaccatcagatccggtaagcggaccttctacaccggtggaggcttaatgaccttctacttatggagaatcctgtacctgagcatgattctaagcgcccgctcgagactgaaggtcttcttcgactggattaaactggcctttttcaagagagacttcttcaaaggcctgtga

SEQ ID NO: 398 - DNA, 1542 bp, Artificial Sequence
  source: /note="Description of Artificial Sequence: Synthetic polynucleotide"
atgctgagcaagaatttgtacagtaacaagaggttgctcaccagcaccaacacgctcgtgcgcttcgccagcaccagatccacaggggtcgaaaacagcggggcaggtcccacctcttttaagaccatgaaggtcatcgacccccagcacagcgacaaaccaaacgtgctgatcctgggctcggggtggggcgccatcagctttctgaagcacatcgacaccaagaagtacaacgttagcatcatcagccctagaagctacttcctgtttacgcctctgttacccagcgccccagttgggacagtagacgaaaagtccattatcgagcccatcgtgaatttcgctctgaagaaaaagggcaacgtcacctactacgaggccgaagccacctctatcaaccccgaccggaataccgtgaccataaagagcctgtctgccgtgagccagctataccaacctgagaaccatctagggctgcaccaggccgagcccgctgagattaagtacgattacctgatcagtgctgtgggcgccgagcctaacacctttggaattcccggcgtgactgattacggtcacttcttcgaggaaatccccaacagcctggaaataagacggacttttgccgccaacctagaggaggccaacctgctgcctaagggcgatcccgagcggagaaggctgctgagcatcgtcgtcgtgggcggagggcccacaggcgtagaagccgctggcgagctgcaggactacgtgcaccaggacctgcggaagtttctgcccgccctggccgaggaagtccagattcacctggtggaagctctgcccatcgtgttgaatatgttcgagaagaagctgagctcatacgcccagtcacatctggaaaacacttccatcaaggtacacctgagaacggccgtggccaaggttgaagagaagcaattgctggccaagaccaagcacgaggacggcaagattaccgaagaaactatcccatacggtactttgatttgggccaccggtaacaaggccagacccgtaatcaccgacctgttcaagaagatccccgagcaaaacagctccaagcggggcttggccgtgaacgactttctgcaggtcaaaggcagcaacaacattttcgccatcggtgacaatgcatttagcggcctgccacctaccgcccaagtggcccaccaagaagccgagtacttggccaagaacttcgataagatggcccaaatccccaatttccaaaagaatctatcttcacggaaggataaaattgacctcttgttcgaggaaaacaactttaagcctttcaaatacaacgacttaggcgccttagcatacctgggcagcgaaagggccattgcaaccataagaagcggcaagcggaccttctacaccggtggaggcctgatgaccttctacctgtggcagatcctgtacctgtccatgatcctgagcgcccgctcgagactgaaggtctttttcgactggatcaagctggcctttttcaaaagggacttcttcaagggcttatga

SEQ ID NO: 399 - DNA, 1542 bp, Artificial Sequence
  source: /note="Description of Artificial Sequence: Synthetic polynucleotide"
atgctgagcaagaacctgtacagtaacaagcggctgctcacctcgaccaacaccctagtgcgcttcgccagcaccagatccaccggggtcgaaaactccggagctggtcccacctctttcaagaccatgaaagtcatcgacccccagcacagcgacaagccaaacgtgctgatactgggctctgggtggggagccattagctttttaaagcacattgacaccaagaagtacaacgtttccatcatctctcctagaagctacttcttattcacccctttgatgcccagcgccccagtgggaacagtggacgagaagtcaattattgagcccatcgtgaacttcgctctcaagaaaaagggcaacgtcacctactatgaggcagaagccaccagcatcaaccccgacaggaataccgtgaccatcaagagcttaagcgccgtgtcccagctgtaccagcctgaaaaccacctgggcctgcaccaggccgaacccgccgagattaagtacgactacttaatcagcgccgtaggcgcggagcccaacacatttggtattcccggcgtgactgattacggtcacttcctgaaagaaatccccaactctttggaaatcagacggacttttgccgccaatctggaaaaggccaacctgctgcctaagggtgaccccgagcggagaagactgctgtccattgtggtggttggcggtgggcctacaggcgtagaggctgctggtgagctgcaggattatgtgcaccaggacctgcggaagttcctgcccgcattggccgaggaagtgcagattcacctggtggaagctctgcccatcgtgttgaatatgttcgagaaaaagcttagcagctacgcccagtcacacctggaaaacacttcgatcaaggtgcacctgagaaccgctgtcgccaaagtggaagagaagcaattgttggccaagaccaaacacgaggacggcaaaattaccgaggaaaccatcccatacggtactctgatttgggccaccggcaacaaggccagaccggtaatcaccgaccttttcaagaagatccccgagcagaacagctccaagcggggactggccgtgaacgacttcctgcaggtggagggcagcaacaacatcttcgccattggtgacaatgcctttgctggcttgccacctacagcccaagtggcccaccaggaggccgaatacatcgccaagaacttcgacaagatggctcagatccccaatttccagaagaacctatcttcaagaaaggataagattgacctgctgttcgaggaaaacaacttcaagcccttcaagtacaacgacctgggtgccctggcatacctgggcagcgaaagagccattgccaccatcagatccggtaagcggacattctacaccggtggtggcctgatgaccttctacttatggcggatcctgtacctgtccatgatcctatctgcccgctcgagattaaaggtcttcttcgactggattaagatggccttcttcaagagggactttttcgagggcctgtga

SEQ ID NO: 400 - DNA, 1542 bp, Artificial Sequence
  source: /note="Description of Artificial Sequence: Synthetic polynucleotide"
atgctgtcgaagaatttgtatagcaaccggcggttgctgaccagcaccaacacgctcgtgcgcttcgccagcaccagatccacaggcgtggaaaactccggggctggccccaccagctttaagaccatgaaagtcattgacccccagcacagcgacaagccaaacgtgctgatcctgggttcggggtggggagccatttcgtttctgaagcacatcgacaccaagaagtacaacgtctccatcatcagccccagaaagtatttcttattcacgcccttgttaccttctgcccctgttgggaccgtggacgagaagtccattatcgagcccatcgtgaacttcgccctgaagaaaaagggcaacgttacctactacgaggccgaagccaccagcatcaaccccgaccggaacaccgtgaccataaagagcctgtctgccgtgtcccagctataccaacccgagaaccacctgggcctgcatcaggccgaacccgccgaaattaagtacgactatttaatcagcgctgtgggcgccgaacccaacacctttggaatccccggcgtgaccgactacggtcatttcctggaggaaatccccaacagcctggaaatcagacggacctttgccgccaacctagaaaaggccaacctgttgccaaagggcgaccccgagagaagaagactgctgtccattgtggtcgtgggtggagggcctactggcgtagaagctgctggcgagctgcaggattacgtgcaccaggacctgagaaagttcttccccgccttggccgaggaagtccaaattcacttggtggaagccctgcccatcgttttgaacatgtttgagaaaaagctgagctcatacgcgcagtcacatttagaaaacacttccatcaaggtgcacctgagaacggccgtggccaaggttgaagagaagcaattgctggccaagaccaagcacgaagacggcaagattaccgaagaaaccatcccctacggcaccctgatttgggccaccggcaacaaggccagacccgtgatcaccgaccttttcaagaaaatccccgagcagaacagctccaagcggggattggccgtgaacgacttcctgcaggtcaaaggcagcaacaacattttcgccatcggcgacaacgcctttgccgggctgcctcctaccgcccaagtggcgcaccaagaagccgaatatctggccaagaactttgataaaatggcccagatacccaatttccagaagaatctgtcttcaagaaaggataagattgacctcctgttcgaggaaaacaactttaagcccttcaagtacaacgacctgggcgccttagcctacctgggcagcgaaagagccattgccaccatccgttccggcaagcggaccttttacaccggtggaggcttaatgaccttctacttatggagaattctgtacttgtccatgatcctatctgcacgcagcagattaaaggtgtttttcgactggattaaactggcatttttcaagagggacttcttcaagggactgtag

SEQ ID NO: 401 - DNA, 1542 bp, Artificial Sequence
  source: /note="Description of Artificial Sequence: Synthetic polynucleotide"
atgctgtcgaagaacctgtacagtaacaagaggctgctgaccagcaccaacaccctcgtgcgcttcgccagcaccagatccaccggcgtggaaaactccggggctggccctacctctttcaagaccatgaaggtcatcgaccctcagcacagcgacaagccaaacgtgctgatcctgggttctggctggggagccatctcgtttctgaagcacatcgacaccaagaagtacaacgttagcatcatctctcccagaagctacttcttacacacccccttgctgcccagcgcccctgtgggaaccgtagacgagaagtccatcatcgagcccatcgttaatttcgctctgaagaaaaagggcaacgtcacctactacgaggccgaggccacctctatcaatcccgacaggaataccgttaccataaagtcactgtctgccgtgagccagctataccaacccgagaaccatctggggctgcaccaggccgagcccgctgagattaagtacgactatttaatcagcgctgtaggtgcggagcccaacacatttggaatccccggggtgaccgactacggccatttcttcgaggagattcccaactctttggaaatccggagaaccttcgccgccaacctagaaaaggccaacctgctgcctaagggtgatcccgagcggagaaggctgctgtccatcgtggtggtgggtggtgggcctactggtgtggaagctgctggcgagctgcaggactatgtgcaccaggacctgcggaagtttctgcccgccctggccgaggaagtccaaattcacctggtggaagccctgcccatcgtgttgaacatgttcgagaagaagcttagctcatacgcgcaaagccacttagaaaacacttcgatcaaggtgcacctgagaacggctgtggccaaggttgaagaaaagcaattgctggcaaagaccaagcacgaagacggtaaaattaccgaagaaaccatcccatacggtactctgatttgggccacgggtaacaaggccagacccgtaatcactgacctgttcaagaagatccccgagcagaacagcagcaagcggggcctggcagtgaacgactttctgcaggtcaaaggcagcaacaacattttcgccattggtgacaacgcatttagcggcctgcctcctaccgcccaggtagcccaccaagaagccgagtacctggccaagaactttgacaagatggctcagataccaaatttccaaaagaacctatcttcccggaaggataaaatcgacctgttgttcgaggagaacaactttaaacccttcaagtacaacgacttaggtgccttagcctacctgggcagcgaaagagccattgccaccatccgtagcggcaagcggaccttttacaccggtggtggcctgatgaccttctacctgtggagaattttgtacatgagcatgattctgagcgcacgcagcagactgaaggtgttcttcgactggatcaagttagcattcttcaagagagactttttcaaaggactgtga

SEQ ID NO: 402 - DNA, 1542 bp, Artificial Sequence
  source: /note="Description of Artificial Sequence: Synthetic polynucleotide"
atgctaagcaagaacctgtacagcaaccggcggctgctcaccagcaccaacaccctcgtgcgcttcgccagcaccagatccaccggcgtggaaaacagcggggctggccccaccagcttcaagaccatgaaagtcatcgacccccagcacagcgacaagcccaacgtgctgatcctgggctcgggctggggcgccatcagctttctgaagcacatcgacaccaagaagtacaacgtcagcatcatcagccccagaagctacttcctgttcacccccctgatgcccagcgcccctgtgggaaccgtggacgagaagtccatcatcgagcccatcgtgaacttcgccctgaagaaaaagggcaacgtcacctactacgaggccgaggccacctctatcaaccccgaccggaacaccgtgaccatcaagagcctgagcgccgtgtcccagctgtaccagcccgagaaccacctgggcatgcaccaggccgagcccgccgagattaagtacgactacctgatcagcgctgtgggcgccgagcccaacacctttggaatccccggcgtgaccgactacggccacttcctgaaagagatccccaacagcctggaaatccggagaaccttcgccgccaacctggaaaaggccaacttactgcctaagggtgaccccgagcggagaaggctgctgagcatcgtggtcgtgggcggaggccccacaggcgtggaagctgctggtgagctgcaggactacgttcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaagtgcacctgagaaccgccgtggccaaggtggaagagaagcaactgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaatgacttcctgcaggtcaaaggcagcaacaacatcttcgccatcggcgacaacgcatttagcgggctgccacctaccgcccaggtggcccaccaggaagccgagtacctggccaagaacttcgacaaaatggcccagatccccaatttccagaagaacctatcctcacggaaggataaaatcgacctgctgttcgaggaaaacaacttcaagcccttcaagtacaacgacttaggtgccctggcatacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgtttttcgactggatcaagctggcattcttcaagagggacttcttcaagggcttatga

SEQ ID NO: 403 - DNA, 1542 bp, Artificial Sequence
  source: /note="Description of Artificial Sequence: Synthetic polynucleotide"
atgctaagcaagaacctgtacagcaacaagcggctgctgaccagcaccaacacgctcgtgcgcttcgccagcaccagatccaccggcgtcgaaaacagcggggctggccccaccagcttcaagaccatgaaggtcatcgaccctcagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgaaaaccacctgggcctgcaccaggccgagcccgccgagattaagtacgattacctgatcagcgccgtgggcgccgaacccaacacatttggaatccctggcgtgaccgactacggccacttcttcaaagagattcccaacagcttggaaatccggcggaccttcgccgccaacctggaaaaggccaacctgctgcctaagggcgaccccgagcggagaaggctgctgagcatcgtcgtcgtgggcggaggccccacaggcgtggaagccgctggcgagctgcaggactacgtgcaccaggacctgcggaagttcctgcctgccctggccgaggaagtgcagattcacctggtggaagccctgcccatcgtgctgaacatgttcgagaaggagctgagcagctacgcccagagccacctggaaaacacttccatcaaagtgcacctgagaaccgccgtggccaaggtggaagagaagcagctgctggccaagaccaagcacgaggacggcaaaattaccgaggaaaccatcccctacggcaccctgatttgggccaccggcaacaaggcaagacccgtgatcaccgacctgttcaagaagatccccgagcagaacagctccaagcggggactggccgtgaacgacttcctgcaggtcaaaggcagcaacaacatcttcgccattggcgacaacgcctttgccgggctgcctcctaccgcccaggtggcccaccaggaagccgagtatctggccaagaacttcgacaagatggcccagatccccaatttccaaaagaacctgtcctcccggaaggataagatcgacctgctgttcgaggaaaacaacttcaagcccttcaagtacaacgacctgggtgccctggcctacctgggcagcgaaagagccattgccaccatcagaagcggcaagcggaccttctacaccggcggaggcttaatgaccttctacctgtggcggatcctgtacctgagcatgatcctgagcgccagaagcagactgaaggtgtttttcgactggatcaagctggccttcttcaagagggacttcttcgagggcctgtga

SEQ ID NO: 404 - DNA, 1542 bp, Artificial Sequence
  source: /note="Description of Artificial Sequence: Synthetic polynucleotide"
atgctgagcaagaacctgtatagcaaccggcggctgctgaccagcaccaacaccctcgtgcgcttcgccagcaccagatccaccggcgtcgaaaacagcggggctggccccacctctttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgatgccctctgcccctgtgggaaccgtggacgagaagtccatcatcgagcccatcgtgaacttcgccctgaagaaaaagggcaacgtcacctactatgaggccgaggccacctctatcaaccccgaccggaacaccgtgaccatcaagagcctgagcgccgtgagccagctgtaccaacccgagaaccacctgggcctgcatcaggccgaacccgccgagattaagtacgactacctgatcagcgccgtgggcgccgagcccaacacctttggaatccccggcgtgaccgattacggccacttcctgaaagagatccccaacagcttggaaatccggcggaccttcgccgccaacctagaaaaggctaacctgctgcctaagggcgaccccgagcggagaaggctgctgagcatcgtcgtcgtgggcggaggccctacaggcgtggaagctgctggcgagctgcaggactacgtgcaccaggacctgcggaagttcctgcccgccctggccgaggaagtgcagattcacctggtggaagccctgcccatcgtgctgaacatgttcgagaaaaagcttagcagctacgcgcagagccacctggaaaacacctccatcaaggtgcacctgagaaccgccgtggccaaagtggaagagaagcagctgctggccaagaccaagcacgaggacggcaagattaccgaggaaaccatcccctacggcaccctgatttgggccaccggcaacaaggccagacccgtgatcaccgacctgttcaagaaaatccccgagcagaacagcagcaagcggggcctggccgtgaacgacttcctgcaggtcaaaggcagcaacaacatcttcgccatcggcgacaacgcctttgctggcctgcctccaacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacttatggcggatcctgtacatgagcatgattctaagcgcccgcagcagactgaaggtgttcttcgactggatcaagatggccttcttcaagagggacttctttaagggactgtga

SEQ ID NO: 405 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctcggggtggggcgccattagctttctgaagcacatcgacaccaagaagtacaacgtctccatcatcagccctagaaagtacttcctgttcacccccctgctgcccagcgccccagtgggaaccgtggacgagaagtccatcatcgagcccatcgttaacttcgccctgaagaaaaaggggaacgtcacctactatgaggccgaggccaccagcatcaaccccgaccggaacaccgttaccatcaagagcttaagcgccgtgtcccagctgtaccagcccgagaaccacctgggcctgcaccaggccgagcccgccgagattaagtacgactacttaatcagcgccgtgggcgccgagcccaacacctttggaatccccggcgtgaccgattacggccacttcctgaaagagatccccaacagcctggaaatccggcggaccttcgccgccaacctggaagaggccaacctgctgcctaagggcgaccccgagcggagaaggctgctgagcatcgtggtggtgggtggaggccccactggcgtggaagctgctggtgagctgcaggactatgtgcaccaggacctgcggaagttcttccccgccctggccgaggaagtccagattcacctggtggaagccctgcccatcgtgctgaacatgtttgagaagaagctgagcagctacgcccagagccacctggaaaacacctccatcaaagtgcacctgagaaccgccgtggccaaggtggaagagaagcaattgctggccaagaccaagcacgaggacggtaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccgggctgcctcctacagcccaggtggcccaccaggaagccgagtacatcgccaagaacttcgacaagatggcccagatacccaatttccagaagaacctgtcctcccggaaggataagatcgacctcctgttcgaggaaaacaacttcaagcccttcaagtacaacgacctgggcgccttagcatacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagatggccttcttcaagagggacttcttcaagggcctgtga

SEQ ID NO: 406 - DNA, 1542 bp, Artificial Sequence
  source: /note="Description of Artificial Sequence: Synthetic polynucleotide"
atgctgagcaagaacctgtacagcaaccggcggctgctgacctcgaccaacaccctcgtgcgcttcgccagcaccagatccaccggggtcgaaaacagcggggctggccccaccagcttcaagaccatgaaggtcattgaccctcagcacagcgacaagcccaacgtgctgatcctgggctcgggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtttcccagctgtaccaacccgagaaccacctgggcatgcaccaggccgaacccgccgagattaagtacgactacctgatcagcgctgtgggcgccgagcccaacacctttggaatccccggcgtgaccgactacggccacttcctgaaagagatccccaacagcctggaaatcagacggactttcgccgccaacctggaaaaggccaacctgttgcctaagggcgaccccgaacggagaaggctgctgagcattgtggtcgtgggcggaggccccactggcgtggaagctgctggcgagctgcaggactacgtgcaccaggacctgcggaagttcctgcccgcactggccgaggaagtgcagattcacctggtggaagccctgcccatcgtgctgaacatgttcgagaagaagctgagcagctacgcccagagccacttagaaaacacctccatcaaggtgcatctgagaaccgccgtggccaaggtggaagagaagcagctgctggcaaagaccaagcacgaggacggcaagattaccgaggaaaccatcccctacggcaccctgatttgggccaccggcaacaaggcaagaccggtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcgcaccaggaagccgaatacctggccaagaacttcgacaagatggcccagatccccaatttccagaagaacctgtcctcccggaaggataagatcgacctgctgttcgaggaaaacaactttaagcccttcaagtacaacgatctgggcgccctggcctacctgggcagcgaaagagccattgccaccataagaagcggcaagcggaccttctacaccggtggaggcctgatgaccttctacctgtggcagatcctgtacctgagcatgatcctgagcgccagaagcagactgaaggtgttcttcgactggatcaagctggccttcttcaagagagacttcttcgagggcctgtga

SEQ ID NO: 407 - DNA, 1542 bp, Artificial Sequence
  source: /note="Description of Artificial Sequence: Synthetic polynucleotide"
atgctgagcaagaacctgtacagtaacaagcggctgctgacctcgaccaacaccctcgtgcgcttcgctagcaccagatccacaggcgtcgaaaacagcggggctggccccaccagcttcaagaccatgaaggtcatcgacccccagcacagcgacaaacccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaacagtggacgagaagtccatcatcgagcccatcgtgaacttcgccctgaagaaaaagggcaacgttacctactacgaggccgaggccaccagcatcaaccccgaccggaacaccgtgaccatcaagaacctgagcgccgtgtcccagctgtaccagcccgagaaccatctgggcctgcaccaggccgagcccgccgagattaagtacgactacttaatcagcgccgtgggcgccgagcccaacacctttggaatccccggcgtgaccgattacggccacttcctgaaagagatccccaacagcctggaaatccggcggactttcgccgccaacctggaggaggccaacctgctgcctaagggcgaccccgagcggagaaggctgctgagcatcgtggtcgtgggcggagggcccactggcgtggaggctgctggcgagctgcaggactacgttcaccaggacctgcggaagttcctccccgccctggccgaggaagtgcagattcacctggtggaagccctgcccatcgtgctgaacatgttcgagaagaagctgagcagctacgcccaaagccacctggaaaacacctcgatcaaggtgcacctgagaaccgccgtggccaaggtggaagagaagcagctgctggccaagaccaagcacgaggacggcaagattaccgaggaaaccatcccctacggtaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttagcgggctgcctcctacagcccaggtggcccaccaggaagccgagtacctggccaagaacttcgacaaaatggcccagatccccaatttccagaagaacctgtcttcccggaaggataagatcgacctgctgttcgaggaaaacaacttcaagcccttcaagtacaacgacctgggcgccctggcctacctgggcagcgaaagagccattgccaccatcagaagcggcaagagaaccttctacaccggcggaggcttaatgaccttctacttatggcagatcctgtacctgagcatgatcctgagcgcccgcagcagactgaaggtgtttttcgactggatcaagttagccttcttcaagagggacttcttcaagggcttatga

SEQ ID NO: 408 - DNA, 1542 bp, Artificial Sequence
  source: /note="Description of Artificial Sequence: Synthetic polynucleotide"
atgctaagcaagaacctgtacagcaacaagcggttgctgaccagcaccaacaccctcgtgcgcttcgccagcaccagatccaccggggtcgaaaactccggggctggccctaccagcttcaagaccatgaaggtcatcgacccccagcacagcgacaagcccaacgtgctgatcctgggctctgggtggggcgccatcagctttctgaagcacatcgacaccaagaagtacaacgttagcatcatcagccccagaagctatttcctgcacacccccctgttaccctctgccccagtgggaaccgtggacgaaaagtccatcatcgagcccatcgtgaacttcgccctgaagaaaaagggcaacgttacctactacgaggccgaggccaccagcatcaaccccgaccggaacaccgtgaccatcaaaagcctgagcgccgtgtcccagctgtaccagcccgagaaccacctgggcatgcaccaggccgagcccgccgagattaagtacgactacctgatcagcgccgtgggtgccgagcccaacacctttggaatccccggcgtgaccgactacggccacttcttcaaagagatccccaacagcctggaaatccggcggaccttcgccgccaacctggagaaggccaacctgctgcctaagggcgaccccgagcggagaaggctgctgagcatcgtggtcgtgggcggaggccccacaggcgtggaggctgctggcgagctgcaggactacgtgcaccaggacctgcggaagttcctgcccgccctggccgaggaagtgcagattcacttggtggaagccctgcccatcgtgctgaacatgttcgagaagaagctgagcagctacgcccagagccacctggaaaacacctcgatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcactgacctgttcaagaagatccccgagcagaacagcagcaagcggggcctggccgtgaacgacttcctgcaggtcaaaggcagcaacaacatcttcgccatcggcgacaacgcctttgccggcctgcctcctaccgcccaggtagcccaccaggaggccgagtacctggccaagaacttcgacaagatggcccagatcccaaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagagaaccttctacaccggcggtggcctgatgaccttctacctgtggcggatcctgtacatgtccatgatcctgagcgcccgctcgagactgaaggtgttcttcgactggatcaagatggccttcttcaagagggacttcttcaagggcctgtga

SEQ ID NO: 409 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtccgcttcgccagcaccagatccacaggggtcgaaaacagcggggctggccccaccagcttcaagaccatgaaggtcatcgacccccagcacagcgacaaacccaacgtgctgatcctgggctcgggctggggcgccatcagctttctgaagcacatcgacaccaagaagtacaacgtcagcatcatcagccccagaagctacttcttattcacccccctgatgcccagcgcccctgtgggaaccgtggacgagaagtccattatcgagcccatcgtgaacttcgccctgaagaaaaagggcaacgtcacctactacgaggccgaggccaccagcatcaaccccgaccggaacaccgtgaccatcaagagcttaagcgccgtgtcccagctgtaccaacccgagaaccacctgggcctgcaccaggccgagcccgccgagattaagtacgactacctgatcagtgccgtgggcgccgagcccaacacctttggaatccctggcgtgaccgactacggccacttcttcaaagagatccccaacagcctggaaatccggcggaccttcgccgccaacctggaaaaggccaacctgctgccaaagggcgaccccgagagaagaaggctgctgagcattgtggtcgtgggcggagggcccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacttagaaaacacctccatcaaggtacacctgagaaccgccgtggccaaggtggaagaaaagcagctgttggccaagaccaagcacgaggacggcaagattaccgaggaaaccattccctacggcactctgatttgggccaccggcaacaaggccagacccgtgatcaccgacctgttcaagaagatccccgagcagaacagcagcaagcggggactggccgtgaacgacttcttgcaggtcaaaggcagcaacaacatcttcgccatcggcgacaacgcctttagcggcctgcctcctacagcccaggtggcccaccaggaagccgagtacctggccaagaacttcgacaagatggcccagatccccaatttccagaagaacctgtcctcccggaaggataagatcgacctcctgttcgaggaaaacaacttcaagcccttcaagtacaacgacctgggcgccttagcctacctgggcagcgaaagagccattgccaccataagaagcggcaagcggaccttctacaccggcggaggcttaatgaccttctacctgtggcagatcctgtacatgagcatgatcctgagcgccagaagcagactgaaggtgttcttcgactggattaagctggccttcttcaagagggacttcttcaagggcctgtga

SEQ ID NO: 410 - DNA, 1542 bp, Artificial Sequence
  source: /note="Description of Artificial Sequence: Synthetic polynucleotide"
atgctgagcaagaacctgtacagcaacaagcggctgctgaccagcaccaataccatggtgcgcttcgccagcaccagatccaccggcgtcgaaaacagcggggctggccctaccagcttcaagaccatgaaggtcatcgacccccagcacagcgacaagcccaacgtgctgatcctgggctctggctggggcgccatcagctttctgaagcacatcgacaccaagaagtacaacgtcagcatcatctctcccagaagctacttcctgttcacccccctgctgcccagcgcacctgtgggaaccgtggacgagaagtccatcattgagcccatcgttaacttcgctctgaagaaaaagggcaacgtcacctactacgaggccgaagccaccagcatcaaccccgaccggaacaccgtgaccatcaagagcctgagcgccgtgtcccagctgtaccaacccgagaaccacctgggcctgcaccaggccgagcccgccgagattaagtacgactatttaatcagtgccgtgggcgccgagcccaacacctttggaatccccggcgtgaccgactacggtcacttcttcgaggagatccccaacagcttggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggattacgtgcaccaggacctgcggaagttcttccccgccctggccgaggaagtgcagattcacctggtggaagccctgcccatcgtgctgaacatgttcgagaagaagctgagcagctacgcccagagccacttagaaaacacctccatcaaggtgcacctgagaaccgccgtggccaaggtggaagagaagcagttgctggccaagaccaaacacgaggacggcaaaattaccgaggaaaccatcccctacggcaccctgatttgggccaccggcaacaaggccagacccgtgatcaccgacctgttcaagaagatccccgagcagaacagcagcaagcggggcttggccgtgaacgacttcctgcaggtcaaaggcagcaacaacatcttcgccatcggcgacaacgcctttgccggcctgccacctacagcccaggtggcccaccaggaagccgagtatctggccaagaacttcgacaagatggcccagatccccaatttccagaagaacctatcctcccggaaggataagatcgacctgctgttcgaggaaaacaacttcaagcccttcaagtacaacgacctgggcgccctggcctacctgggcagcgaaagagccattgccaccataagaagcggcaagcggaccttctacaccggcggtggcctgatgaccttctacctgtggcagatcctgtacctgagcatgatcctgagcgcccgcagcagactgaaggtgttcttcgactggatcaagttagcattcttcaagagggacttcttcaagggattatga

SEQ ID NO: 411 - DNA, 1542 bp, Artificial Sequence
  source: /note="Description of Artificial Sequence: Synthetic polynucleotide"
atgctgagcaagaacctgtatagcaaccggcggctgctcaccagcaccaacaccctcgtgcgcttcgcctccaccagatccaccggcgtcgaaaacagcggagctggccccaccagctttaagaccatgaaggtcatcgacccccagcacagcgacaagcccaacgtgctgatcctgggctctggctggggcgccatctcgtttctgaagcacatcgacaccaagaagtacaacgtcagcatcatcagccccagaaagtacttcttattcacccccctgatgcccagcgcccctgtgggaaccgtggacgagaagtccatcatcgagcccatcgttaacttcgccctgaagaaaaagggcaacgttacctactacgaggccgaggccaccagcatcaaccccgaccggaacaccgtgaccatcaagtcactgtctgccgtgtcccagctgtaccagcccgagaaccatctgggcctgcaccaagccgagcctgccgagattaagtacgactacctgatcagcgctgtgggcgccgagcccaacacctttggaatccccggcgtgaccgactacggccacttcctgaaagagattcccaacagcctggaaatccggcggaccttcgccgccaacctggaaaaggccaacctgctgcctaagggcgaccccgagcggagaaggctgctgagcattgtggtcgtgggcggaggccccacaggcgtggaagccgctggcgagctgcaggactacgtgcaccaggacctgcggaagttcttccctgccctggccgaggaagtgcagattcacctggtggaagccctgcccatcgttctgaacatgttcgagaagaagctgagcagctacgcccagagccacctggaaaacacctccatcaaggtgcacctgagaacggccgtggccaaggtggaagagaagcagctgctggccaagaccaagcacgaggacggcaagattaccgaggaaaccatcccctacggcaccctgatttgggccaccggtaacaaggccagacccgtgatcaccgacctgttcaagaagatccccgagcagaacagcagcaagcggggcctggccgtgaatgacttcctgcaggtcaaaggcagcaacaacatcttcgccatcggtgacaacgcctttgccggcttgcctcctacagcccaggtggcccaccaggaagccgagtacctggccaagaacttcgacaagatggcccaaatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggtggaggcctgatgaccttctacctgtggcagatcctgtacctgagcatgatcctgagcgcccgcagcagactgaaggtgttcttcgactggattaagctggccttcttcaagagggacttcttcaagggcctgtag

SEQ ID NO: 412 - DNA, 1542 bp, Artificial Sequence
  source: /note="Description of Artificial Sequence: Synthetic polynucleotide"
atgctgagcaagaacctgtacagcaaccggcggctgctcaccagcacgaacaccctcgtgcgcttcgccagcaccagatccacaggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatctctcccagaaagtatttcctgcacacccccctgctgcccagcgcccctgtgggaaccgtggacgagaagtccatcattgagcccatcgtgaacttcgccctgaagaaaaaggggaacgtcacctactacgaggccgaggccaccagcatcaaccccgaccggaataccgtgaccatcaagaacctgagcgccgtttcccagctgtaccagcccgagaaccacctgggcctgcaccaggccgagcccgccgagattaagtacgactacctgatcagcgccgtgggcgccgagcccaacacctttggaatccctggcgtgaccgactacggccacttcctgaaagaaatccccaacagcctggaaatccggagaaccttcgccgccaacctggaaaaggccaacctgctgcctaagggcgaccccgagcggagaaggctactgagcatcgtggtcgtgggcggaggccccacaggtgtggaagctgctggcgagctgcaggattacgtgcaccaggacctgcggaagttcctgcccgccctggccgaggaagtgcagattcacctggtggaagctctgcccatcgttctgaacatgttcgagaagaagctgagcagctacgcccagagccacctggaaaacacctccatcaaggtgcacctgagaaccgctgtggccaaggtggaagagaagcagctgctggccaagaccaagcacgaggacggcaagattaccgaggaaaccatcccctacggcactctgatttgggccaccggcaacaaggccagacccgtaatcaccgacctgttcaagaagatccccgagcagaacagctccaagcggggcctggccgtgaacgactttctgcaggtcgagggcagcaacaacatcttcgccatcggcgacaacgcctttgccggcctgcctcctacagcccaggtggcccaccaagaagccgagtacctggccaagaatttcgacaagatggcccaaatccccaatttccagaagaacctgtcctcccggaaggataagatcgacctgctgttcgaggaaaacaacttcaagcccttcaagtacaacgacctgggcgccctggcctacctgggcagcgaaagagccattgccaccataagaagcggcaagcggaccttctacaccggcggaggcttaatgaccttctacctgtggcggatcctgtacctgagcatgatcctgtctgccagaagcagactgaaggtgttcttcgactggatcaagctggccttcttcaagagggacttcttcaagggcctgtga

SEQ ID NO: 413 - DNA, 1542 bp, Artificial Sequence
  source: /note="Description of Artificial Sequence: Synthetic polynucleotide"
atgctgagcaagaatctgtacagcaacaagcggctgctcaccagcaccaacacgctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgctatcagctttctgaagcacatcgacaccaagaagtacaacgtcagcatcatcagccccagaagctatttcctgttcacccctctgatgcccagcgcccctgtgggaaccgtggacgagaagtccatcatcgagcccatcgtgaacttcgccctgaagaaaaagggcaacgtcacctactacgaggcagaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacatttggaatccccggcgtcaccgactacggccacttcttcaaggagatccccaacagcctggaaatccggcggaccttcgccgccaacctggaaaaggccaacctgctgcctaagggcgaccccgagagaagaaggctgctgagcatcgtggtcgtgggcggaggccccacaggcgtggaagctgctggtgaactgcaggactacgtgcaccaggacctgcggaagttcctgcccgccctggccgaggaagtgcagattcacctggtggaagccctgcccatcgtgctgaacatgttcgagaaggagctgagctcatacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaatgcctttgccggcctgcctcctacagcccaggtggcccaccaggaagccgagtacctggccaagaacttcgataagatggctcagatccccaatttccagaagaacctatcctcacggaaggataagatcgatctcctgttcgaggagaacaacttcaagcctttcaagtacaacgacctgggcgccctggcctacctgggcagcgaaagagccattgccaccatcagatccggtaagcggaccttctacaccggcggaggcctgatgaccttctacctgtggcggatcttgtacatgagcatgatcctgagcgcccgcagcagactgaaggtgttcttcgactggatcaagatggccttcttcaagagggacttttttaagggcctgtga

SEQ ID NO: 414 - DNA, 1542 bp, Artificial Sequence
  source: /note="Description of Artificial Sequence: Synthetic polynucleotide"
atgctgagcaagaacctgtacagcaacaagaggctgctcaccagcaccaacacgctcgtgcgcttcgccagcaccagatccaccggcgtcgaaaacagcggggctggccccacaagcttcaagaccatgaaggtcatcgacccccagcacagcgacaaacccaacgtgctgatcctgggctctggctggggcgccatcagctttctgaagcacattgacaccaagaagtacaacgtcagcatcatcagccccagaaagtacttcctgttcacccctctgctgcctagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccatctgggcctgcatcaggccgagcccgccgagattaagtacgactatctgatcagcgccgtgggcgccgagcccaacacctttggaattcccggcgtgaccgactacggccacttcctggaggagatccccaacagcctggaaatccggcggaccttcgccgccaacctggaaaaggccaacctgttgcctaagggcgaccccgagcggagaaggctgctgagcatcgtggtcgtgggcggaggccccacaggcgtggaagctgctggtgagctgcaggactacgtgcaccaggacctgcggaagttcttccccgccctggccgaggaagtgcagattcacctggtcgaagctctgcccatcgtgttgaacatgttcgagaagaagctgagcagctacgcccagagccacctggaaaacacttccatcaaggtgcacctgagaaccgccgtggccaaggtggaagagaagcagttgctggccaagaccaagcacgaggacggcaagattaccgaggaaaccatcccctacggcaccctgatttgggccaccggcaacaaggccagacccgtgatcaccgacctgttcaagaagatccctgagcagaactcgagcaagcggggcttggccgtgaacgacttcctgcaggtgaaaggcagcaacaacatcttcgccatcggtgacaacgcctttgccggcctgcctcctacagcccaggtggcccaccaggaagccgagtacatcgccaagaacttcgacaagatggcccagatccccaatttccagaagaacctgtcctccagaaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggattctgtacctgagcatgatcctgagcgccagaagcagactgaaggtgttcttcgactggatcaagctggccttcttcaagagggacttcttcgagggactgtga

SEQ ID NO: 415 - DNA, 1542 bp, Artificial Sequence
  source: /note="Description of Artificial Sequence: Synthetic polynucleotide"
atgctgagcaagaacctgtacagtaaccggcggctgctgaccagcaccaacaccctcgtgcgcttcgccagcaccagatccaccggcgtcgaaaactccggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgcacacccccctgctgcccagcgcccctgtgggaaccgtggacgagaagtccatcatcgagcccatcgtgaacttcgccctgaagaaaaaggggaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgcggagcccaacacctttggaatccccggcgtgaccgactacggccatttcctgaaagagatccccaactctctggaaatacggcggacctttgccgccaacctggaaaaggccaacctgctgcctaagggcgaccccgagcggagaaggctgctgagcatcgtggtcgtgggcggagggcccacaggcgtggaagctgctggcgagctgcaggactacgtgcaccaggacctgcggaagttcctgcccgcactggccgaggaagtgcagattcacctggtggaagccctgcccatcgtgctgaatatgttcgagaagaagctgagcagctacgcccagagccacttagaaaacacctccatcaaggtacacctgagaaccgccgtggccaaggtggaagagaagcagctgctggccaagaccaagcacgaggacggcaagataaccgaggaaaccatcccctacggcaccttgatttgggccaccggcaacaaggccagacccgtgatcaccgacctgttcaagaagatccccgagcagaacagcagcaagcggggcctggccgtgaacgactttctgcaggtcaaaggcagcaacaacatcttcgccatcggcgacaacgcatttagcggcctgcctcctacagcccaggtggcccaccaggaagccgaatatatcgccaagaactttgacaagatggcccagatacccaatttccagaagaacctgtcctcccggaaggataagatcgatctcctgttcgaggaaaacaacttcaaacccttcaagtacaacgacctgggcgccctggcatacctgggcagcgaaagagccattgccaccatcagaagcggcaagcggaccttctacaccggtggaggcctgatgaccttctacctgtggcggatcctgtacctgagcatgatcctgagcgcccgcagcagactgaaggtgttcttcgactggatcaagctggcctttttcaagagggacttcttcaagggactgtga

SEQ ID NO: 416 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccacaggcgtcgaaaacagcggggctggccccaccagcttcaagaccatgaaggtcatcgacccccagcacagcgacaagcccaacgtgctgatcctgggctctggctggggcgccatcagctttttaaagcacatcgacaccaagaagtacaacgtcagcatcatcagccccagaagctacttcctgttcacccctctgctgcccagcgcccctgtgggaaccgtggacgagaagtccatcatcgagcccatcgtgaacttcgccctcaagaaaaagggcaacgtcacctactacgaggccgaggccaccagcatcaaccccgaccggaacaccgtgaccatcaagagcctgtctgccgtgtcccagctgtaccagcctgagaaccacctgggcctgcaccaggccgagcccgccgagattaagtacgactacctgatcagcgctgtgggcgccgagcccaacacctttggaatccccggcgtgaccgactacggccacttcttcaaagagatccccaacagcttggaaatacggcggaccttcgccgccaatctggaagaggccaacctgctgcctaagggtgaccccgagcggagaaggctgctgagcatcgtcgtcgtgggcggagggcccacaggcgtggaagctgctggcgaactgcaggactacgttcaccaggacctgcggaagttcctgcccgccctggccgaggaagtgcagattcacctggtggaagccctgcccatcgtgctgaacatgttcgagaaagagctgtcaagctacgcccagagccatctggaaaacacctccatcaaggtgcacctgagaaccgccgtggccaaggtggaagagaagcagctgctggccaagaccaagcacgaggacggcaagattaccgaggaaaccatcccctacggtactctgatttgggccaccggcaacaaggccagacccgtgatcactgacctgttcaagaagatccccgagcagaacagcagcaagcggggcctggccgtgaacgactttctgcaggtcaaaggcagcaacaacatcttcgccatcggtgacaacgcctttgccggcctgcctcctacagcccaggtggcccaccaggaagccgagtacatcgccaagaacttcgataagatggcccagatccccaatttccagaagaacctgtcctcccggaaggataagatcgacctgctgttcgaggaaaacaacttcaagcctttcaagtacaacgacctgggcgccctggcctacctgggcagcgaaagagccattgccaccatcagaagcggcaagcggaccttctacaccggcggaggcttaatgaccttctacctgtggcggatcctgtacttgagcatgatcctgagcgccagaagcagactgaaggtgtttttcgactggatcaagatggccttcttcaagagggacttcttcaagggcctgtga

SEQ ID NO: 417 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccacaggcgtggaaaactccggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccctagaagctacttcctgttcacccccctgctgcccagcgcacctgtgggaaccgtggacgagaagtccatcattgagcccatcgtgaacttcgctctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacatttggaatccccggcgtgaccgactacggccatttcctgaaagagatccccaactctctggaaatccggcggaccttcgccgccaacctggaagaggctaacctgctgcctaagggcgatcccgaacggagaagactactgagcattgtggtcgtgggcggaggccccacaggcgtggaagctgctggcgagctgcaggactatgtgcaccaggacctgcggaagttcctccccgccctggccgaggaagtgcagattcacctggtggaagccctgcccatcgtgctgaacatgttcgagaaggagctgagcagctacgcccagagccacctggaaaacacctcgatcaaggtgcacctgagaaccgccgtggccaaggtggaagagaagcagctgctggccaagaccaagcacgaagacggcaagattaccgaggaaaccatcccatacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccattggtgacaacgcctttgccggcctgcctcctaccgcccaggtggcccaccaggaagccgagtacctggccaagaacttcgacaagatggcccagatccccaatttccagaagaacctatcctcccggaaggataagatcgatctgctgttcgaggaaaacaacttcaagcccttcaagtacaacgatctgggcgccctggcctacctgggctccgaaagagccattgccaccatcagaagcggcaagcggaccttctacaccggcggaggcctgatgaccttctacctgtggcagatcctgtacctgagcatgatcctgagcgcccgcagcagactgaaggtgttcttcgactggattaagatggccttcttcaagagggacttcttcaagggcctgtga

SEQ ID NO: 418 - DNA, 1542 bp, Artificial Sequence
  source: /note="Description of Artificial Sequence: Synthetic polynucleotide"
atgctgagcaagaacttgtacagcaacaagcggctgctgaccagcaccaacaccctcgtgagattcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttttaaagcacatcgacaccaagaagtacaacgtctccatcatcagccccagaaagtacttcctgttcacccccctgctgccctctgcccctgtgggaaccgtggacgagaagtccatcatcgagcccatcgtgaacttcgccctgaagaaaaagggcaacgtcacctactacgaggcagaggccaccagcatcaaccccgaccggaacaccgtgaccatcaagagcttaagcgccgtttcccagctgtaccaacctgagaaccacctgggcctgcatcaggccgagcccgccgagattaagtacgactacctgatcagcgccgtaggcgccgagcccaacacctttggaatccccggggtgactgactacggccacttcctgaaagaaatccccaacagcctggaaatccggcggaccttcgccgccaacctggaaaaggccaacctgctgcctaagggcgaccccgaacggagaaggctgctgagcatcgtggtcgtgggcggaggccccacaggcgtggaagctgctggcgagctgcaggactacgtgcaccaggacctgcggaagttcttccccgccctggccgaggaagtccagattcacctggtggaagccctgcccatcgtgctgaacatgttcgagaagaagctgagcagctacgcccagagccacctggaaaacacctccatcaaggtgcacctgagaaccgctgtggccaaggtggaagagaagcagctgctggccaagaccaagcacgaggacggcaagattaccgaggaaaccatcccctacggcactctgatttgggccaccggcaacaaggccagacccgtgatcactgacctgttcaagaagatccccgagcagaacagcagcaagagaggcctggccgtgaacgacttcctgcaggtcgagggcagcaacaacatcttcgccatcggcgacaacgcctttagcgggctgcctcctacagcccaggtggcccaccaggaagccgagtacctggccaagaacttcgacaagatggctcagatcccaaatttccagaagaacctgtcctcccggaaggataagatcgacctgctgttcgaggaaaacaacttcaagcccttcaagtacaacgacctgggcgccctggcatacctgggcagcgaaagagccattgccaccatcagaagcggcaagcggaccttctacaccggcggtggcctgatgaccttctacctgtggcggatcctgtacctgagcatgatcctgagcgcccgcagcagactgaaggtcttcttcgactggatcaagctggcctttttcaagagggacttcttcgagggcctgtag

SEQ ID NO: 419 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttttaaagcacatcgacaccaagaagtacaacgttagcatcatcagccccagaagctacttcctgttcacccccctgctgcccagcgcccctgttggaacagtggacgagaagtccatcatcgagcccatcgtgaactttgccctgaagaaaaagggcaacgtcacctactacgaggccgaggccaccagcatcaatcccgaccggaacaccgtgaccatcaagagcctgagcgccgtgtcccagctgtaccagcccgagaaccacctgggcctgcaccaggcagagcccgccgaaattaagtacgattacctgatcagcgccgtgggcgccgagcccaacacctttggaattcccggcgtgaccgactacggccacttcctggaggagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgttctgaacatgttcgagaagaagctgagcagctacgcccagtcacacctggaaaacacttccatcaaggtgcacctgagaaccgccgtggccaaggtggaagagaagcagttgctggccaagaccaaacacgaggacggcaagattaccgaggaaaccatcccctacggtactctgatttgggccaccggcaacaaggcaagacccgtgatcaccgaccttttcaagaagatccccgagcagaacagcagcaagcggggcctggcagtgaacgacttcctgcaggtcgagggcagcaacaacatcttcgccatcggcgacaacgcatttgccggcctgcctcctacagcccaggtggcccaccaggaagccgaatacctggccaagaacttcgacaagatggcccagatccccaatttccaaaagaacctgtcctcacggaaggataagatcgacctgctgttcgaggaaaacaacttcaagcccttcaagtacaacgatctgggcgccctggcctacctgggcagcgaaagagccattgccaccatccgtagcggcaagcggaccttctacaccggcggaggcctgatgaccttctacctgtggcggatcctgtacctgagcatgattctgagcgcccgcagcagactgaaggtgttcttcgactggattaagatggccttcttcaagagggactttttcaagggcctgtga

SEQ ID NO: 420 - DNA, 1542 bp, Artificial Sequence
  source: /note="Description of Artificial Sequence: Synthetic polynucleotide"
atgctgagcaagaacttgtacagcaacaagcggctgctgaccagcaccaacacgatggtgcgcttcgccagcaccagatccacaggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccctagaagctacttcctgcacacccccctgctgcccagcgccccagtgggaaccgtggacgagaagtccatcatcgagcccatcgtgaacttcgccctgaagaaaaagggcaacgttacctactacgaggccgaggccaccagcatcaatcccgaccggaacaccgtgaccatcaagaacctgagcgccgtgagccagctgtaccagcccgagaaccacctgggcctgcaccaggccgagcccgccgagattaagtacgactacctgatcagcgccgtgggcgcggaacccaacacctttggaatccccggcgtgaccgactacggccacttcctgaaagagattcccaacagcctggaaatccggcggaccttcgccgccaacctggagaaggccaacctgttgcctaagggcgaccccgagcggagaaggctgctgagcatcgtggtcgtgggcggaggccccacaggcgtggaagctgctggcgagctgcaggactacgtgcaccaggacctgcggaagttcctgcccgcactggccgaagaagtgcagattcacctggtcgaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtaatcaccgacctgttcaagaagattcctgagcagaacagcagcaagcggggactggccgtgaacgacttcttgcaggtcaaaggcagcaacaacatcttcgccatcggtgacaacgcctttgctggcctgcctcctacagcccaggtggcccaccaggaagccgagtacctggccaagaacttcgacaagatggcccagatccccaatttccagaagaacctgtcctcacggaaggataagatcgacctcctgttcgaggaaaacaacttcaagcccttcaagtacaacgacctgggcgccctggcctacctgggcagcgaaagagccattgccaccatcagatccggcaagcggaccttctacaccggcggaggcctgatgaccttctacctgtggcggatcctgtacctgagcatgatcctgagcgcccgcagcagactgaaggtgttcttcgactggatcaagatggccttcttcaaaagggacttcttcgagggactgtga

SEQ ID NO: 421 - DNA, 1542 bp, Artificial Sequence
  source: /note="Description of Artificial Sequence: Synthetic polynucleotide"
atgctaagcaagaacctgtacagcaaccggcggctgctgacctcgaccaacaccctcgtgcgcttcgccagcaccagatccaccggcgtcgaaaacagcggggctggccccaccagcttcaagaccatgaaggtcatcgacccccagcacagcgacaagccaaacgtgctgatcctgggctctggctggggcgccatcagctttctgaagcacatcgacaccaagaagtacaacgtcagcatcatctctcccagaagctacttcctgcacacccctctgctgcccagcgcacctgtgggaaccgtggacgagaagtccatcatcgagcccatcgtgaatttcgccctgaagaaaaagggcaacgtcacctactacgaggccgaggccaccagcatcaaccccgaccggaacaccgtgaccatcaagagcctgagcgccgtttcccagctgtaccagcccgagaaccacctgggcctgcaccaggccgagcccgccgagattaagtacgactacctgatcagcgccgtgggcgccgagcccaacacctttggtatccccggggtgaccgactacggccacttcctgaaagagatccccaacagcctggaaatccggcggacctttgccgccaacctggaaaaggctaacctgctgcctaagggcgaccccgaacggagaaggctgctgagcatcgtggtggtgggcggaggccccacaggcgtggaagctgctggcgagctgcaggattacgttcaccaggacctgcggaagttcctgcccgccctggccgaggaagtgcagattcacctggtggaagccctgcccatcgtgctgaacatgttcgagaagaagctgagctcatacgcccagtcacacctggaaaacacctcgatcaaggtgcacctgagaaccgccgtggccaaggttgaagagaagcagctgctggccaagaccaagcacgaggacggcaagattaccgaggaaaccatcccctacggcaccctgatttgggccaccggcaacaaggccagacccgtgatcaccgacctgttcaagaaaatccctgagcagaacagcagcaagcggggcctggccgtgaacgactttttgcaggtcaaaggcagcaacaacatcttcgccatcggcgacaacgcctttgccggcctgcctcctacagcccaggtggcccaccaggaagccgagtacctggccaagaactttgacaagatggcccagatcccaaatttccagaagaacctgtcctcccggaaggataagatcgacctgttgttcgaggaaaacaacttcaagcccttcaagtacaacgacttaggcgccctggcctacctgggcagcgaaagagccattgccaccatcagaagcggcaagcggaccttctacaccggcggtggcctgatgaccttctacctgtggcagatcctgtacatgagcatgatcctgagcgcccgcagcagactgaaggtgttcttcgactggatcaagatggccttcttcaagagggacttcttcaagggcctgtga

SEQ ID NO: 422 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacctgagcatgatcctgagcgcccgcagcagactgaaggtgttcttcgactggatcaagatggccttcttcaagagggacttcttcgagggcctgtga

SEQ ID NO: 423 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagatggccttcttcaagagggacttcttcgagggcctgtga

SEQ ID NO: 424 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 425 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttagcggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 426 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcttcaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcgagggcctgtga

SEQ ID NO: 427 - DNA, 1542 bp, Artificial Sequence
  source: /note="Description of Artificial Sequence: Synthetic polynucleotide"
atgctgagcaagaacctgtacagcaaccggcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 428 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttagcggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagatggccttcttcaagagggacttcttcgagggcctgtga

SEQ ID NO: 429 - DNA, 1542 bp, Artificial Sequence
  source: /note="Description of Artificial Sequence: Synthetic polynucleotide"
atgctgagcaagaacctgtacagcaaccggcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 430 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 431 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcgagggcctgtga

SEQ ID NO: 432 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 433 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcgagggcctgtga

SEQ ID NO: 434 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 435 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 436 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 437 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 438 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 439 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 440 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcgagggcctgtga

SEQ ID NO: 441 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagatggccttcttcaagagggacttcttcaagggcctgtga

SEQ ID NO: 442 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttacacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttagcgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaattagcatttttcaaaagagacttttttgagggattatag

SEQ ID NO: 443 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcttcgaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaattagcatttttcaaaagagacttttttaaaggattatag

SEQ ID NO: 444 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcgaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaaatggcatttttcaaaagagacttttttaaaggattatag

SEQ ID NO: 445 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttagcgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacatgtccatgattctatctgcaagatcgagattaaaggtctttttcgactggattaaattagcatttttcaaaagagacttttttgagggattatag

SEQ ID NO: 446 - DNA, 1542 bp, Artificial Sequence
  source: /note="Description of Artificial Sequence: Synthetic polynucleotide"
atgctatcgaagaatttgtatagtaaccggaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttacacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttgagggattatag

SEQ ID NO: 447 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttacacacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttgagggattatag

SEQ ID NO: 448 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttacacacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacatgtccatgattctatctgcaagatcgagattaaaggtctttttcgactggattaaaatggcatttttcaaaagagacttttttaaaggattatag

SEQ ID NO: 449 - DNA, 1542 bp, Artificial Sequence
  source: /note="Description of Artificial Sequence: Synthetic polynucleotide"
atgctatcgaagaatttgtatagtaaccggaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttagcgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacatgtccatgattctatctgcaagatcgagattaaaggtctttttcgactggattaaattagcatttttcaaaagagacttttttaaaggattatag

SEQ ID NO: 450 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttagcgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttgagggattatag

SEQ ID NO: 451 - DNA, 1542 bp, Artificial Sequence
  source: /note="Description of Artificial Sequence: Synthetic polynucleotide"
atgctatcgaagaatttgtatagtaaccggaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcgaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaaatggcatttttcaaaagagacttttttgagggattatag

SEQ ID NO: 452 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcttcgaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacatgtccatgattctatctgcaagatcgagattaaaggtctttttcgactggattaaattagcatttttcaaaagagacttttttaaaggattatag

SEQ ID NO: 453 - DNA, 1542 bp, Artificial Sequence
  source: /note="Description of Artificial Sequence: Synthetic polynucleotide"
atgctatcgaagaatttgtatagtaaccggaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttagcgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacatgtccatgattctatctgcaagatcgagattaaaggtctttttcgactggattaaaatggcatttttcaaaagagacttttttaaaggattatag

SEQ ID NO: 454 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttacacacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaaatggcatttttcaaaagagacttttttgagggattatag

SEQ ID NO: 455 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcgaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttagcgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttgagggattatag

SEQ ID NO: 456 - DNA, 1542 bp, Artificial Sequence
  source: /note="Description of Artificial Sequence: Synthetic polynucleotide"
atgctatcgaagaatttgtatagtaaccggaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcgaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacatgtccatgattctatctgcaagatcgagattaaaggtctttttcgactggattaaattagcatttttcaaaagagacttttttgagggattatag

SEQ ID NO: 457 - DNA, 1542 bp, Artificial Sequence
  source: /note="Description of Artificial Sequence: Synthetic polynucleotide"
atgctatcgaagaatttgtatagtaaccggaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaattagcatttttcaaaagagacttttttaaaggattatag

SEQ ID NO: 458 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttacacacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcgaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttgctgggttgccaccaaccgcccaagtagcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggcagattttgtacttgtccatgattctatctgcaagatcgagattaaaggtctttttcgactggattaaaatggcatttttcaaaagagacttttttaaaggattatag

SEQ ID NO: 459 - DNA, 1542 bp, Artificial Sequence
  source: /note="Description of Artificial Sequence: Synthetic polynucleotide"
atgctatcgaagaatttgtatagtaaccggaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaaaacttatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtggagggcagcaacaacattttcgccattggtgacaatgcatttgctgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttgagggattatag

SEQ ID NO: 460 - DNA, 1542 bp, Artificial Sequence
  source: /note="Description of Artificial Sequence: Synthetic polynucleotide"
atgctatcgaagaatttgtatagtaaccggaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttacacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcttcgaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaagagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttagcgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaaatggcatttttcaaaagagacttttttaaaggattatag

SEQ ID NO: 461 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaaagtatttcttatttacgcctttgatgccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggatgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttttccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagaccaaacacgaagacggtaaaataaccgaagaaactattccatacggtactttgatttgggccacgggtaacaaggcaagaccggtaatcactgaccttttcaagaaaattcctgagcaaaactcgtccaagagaggattggcagtgaatgactttttgcaggtgaaaggcagcaacaacattttcgccattggtgacaatgcatttagcgggttgccaccaaccgcccaagtagcgcaccaagaggccgaatatatcgccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaaatggcatttttcaaaagagacttttttgagggattatag

SEQ ID NO: 462 - DNA, 1542 bp, Artificial Sequence
  source: /note="Description of Artificial Sequence: Synthetic polynucleotide"
atgctgtcgaagaatttgtatagtaaccggaggttgctcacctcgacgaataccatggtgagattcgctagcaccagatccaccggggtcgaaaactccggagcaggtcccacatcttttaagaccatgaaggtcattgacccccagcacagcgacaaacccaacgtgctgatcctgggttcgggctggggagctatttcgtttttaaagcacattgacaccaagaagtacaacgtttccatcatctctcccagaagctatttcttattcacgcctttgatgccttctgcaccagttgggaccgtagacgaaaagtcaattatcgagcccatcgttaactttgctctcaagaaaaaggggaacgtcacctactatgaggcagaagccaccagcatcaaccccgaccggaacaccgttaccataaagtcactgagcgccgtttcccagctataccagcccgaaaaccacctagggctgcatcaagcagaacctgccgagattaagtacgactacttaatcagcgctgtgggtgccgagcccaacacatttggaattcctggcgtcaccgattacggtcatttcctgaaggaaattcccaactctttggaaataagaagaacttttgccgccaacctggaagaggccaacttattgcctaagggtgatcccgaaagaagaaggctactgtccattgtcgtcgttggcggtggccctactggtgtagaagccgctggcgaactgcaggattatgttcaccaggacctgagaaagtttttccctgcattggccgaagaagtccaaattcacttggtcgaagctctgcccatcgttctgaatatgtttgagaaggagctttcaagctacgcccagtcacatttagaaaacacctccatcaaagtgcatctgagaacggctgtggccaaagttgaagaaaagcagttgttggcaaagaccaaacacgaagacggtaaaattaccgaggaaactattccatacggcactctgatttgggccacgggtaacaaggccagacccgtaatcactgaccttttcaagaaaattcctgagcaaaactcgagcaagagaggattggccgtgaacgactttttgcaggtggagggcagcaacaacattttcgccatcggtgacaatgcctttagcgggttgccacctaccgcccaagtggcccaccaagaggccgaatatttggccaagaattttgataagatggctcagataccaaatttccaaaagaatctatcctcacggaaggataaaattgatctcttgttcgaggagaacaactttaaacctttcaagtacaacgacctgggtgccttagcatacctgggatccgaaagggccattgcaaccatccgtagcggtaagcggacattctacaccggtggaggcttaatgaccttctacttatggcagattttgtacctgtccatgattctaagcgccagatcgagattaaaggtctttttcgactggattaagatggcatttttcaagagggactttttcaaaggcctgtag

SEQ ID NO: 463 - DNA, 1542 bp, Artificial Sequence
  source: /note="Description of Artificial Sequence: Synthetic polynucleotide"
atgctatcgaagaatttgtatagtaaccggcggctgctcacctcgacgaataccatggtgagattcgcttccaccagatccacaggggtcgaaaactccggagcaggtcctacatcttttaagaccatgaaggtcatcgacccccagcacagcgacaaacccaacgtgctgatcctgggctcggggtggggcgctatcagctttctgaagcacattgacaccaagaagtacaacgtttccatcatctctcctagaaagtatttcttacacacgcctctgatgccttctgcacctgttgggacagtagacgaaaagtcaatcattgagcccatcgttaattttgctctcaagaaaaagggcaacgtcacctactatgaggcagaagccacctctatcaaccccgaccggaacaccgttaccataaaaagcttaagcgccgtgagccagctataccaacctgaaaaccatctaggcatgcatcaggccgaacccgctgaaattaagtacgactatctgatcagtgctgtaggtgcggaacctaacacatttggtattcctggcgtgactgactacggtcatttcctgaaggaaatccccaacagcttggaaatacggagaacttttgccgccaatctagagaaggctaacctgttgccaaagggtgaccccgaacggagaaggctgctgagcatcgtcgtggttggcggtgggcctactggcgtagaggctgctggcgaactgcaggattatgttcaccaggacctgcggaagtttttccctgcattggccgaagaagtccaaattcacctggtcgaagctctgcccatcgttctgaatatgtttgagaaagagctgtcatcatacgcccagtcacatctggaaaacacctccatcaaggtgcacctgagaacggctgtcgccaaagtggaagagaagcaactgttggcaaagaccaagcacgaagacggtaaaataaccgaagaaactattccatacggtactttgatttgggccacgggtaacaaggcaagaccggtgatcaccgacctgttcaagaagattcctgagcaaaactcgtccaagcggggattggcagtgaatgacttcttgcaggtggagggcagcaacaacattttcgccattggtgacaacgcatttgctgggttgccacctacagcccaggtagcgcaccaagaggccgagtatctggccaagaatttcgataagatggctcaaataccaaatttccaaaagaatctgtcttcacggaaggataaaattgatctgctgttcgaggagaacaacttcaaacctttcaaatacaacgacttaggtgccttagcatacctgggatccgaaagggccattgcaaccataagatccggtaagagaacattctacaccggcggtggcttaatgaccttctacttatggagaatcttgtacatgtccatgatcctatctgcacgcagcagattaaaggtctttttcgactggatcaaattagccttcttcaaaagagactttttcaaaggcctgtga

SEQ ID NO: 464 - DNA, 1542 bp, Artificial Sequence
  source: /note="Description of Artificial Sequence: Synthetic polynucleotide"
atgctgtcgaagaacttgtacagtaacaagaggttgctgacctcgaccaacacgctagtgagattcgcttccaccagatccaccggggtggaaaacagcggggcaggccccacaagcttcaagaccatgaaagtcattgaccctcagcacagcgacaagccaaacgtgctgatcctgggttctgggtggggagctatttcgtttttaaagcacatcgacaccaagaagtacaacgtctccatcatcagccctagaagctatttcttatttacgcctttgatgcccagcgcacctgttgggacagtggacgagaagtcaatcattgagcccatcgtgaattttgccctgaagaaaaaggggaacgttacctactatgaggcagaagccaccagcatcaatcccgaccggaacaccgttaccataaagtcattatctgccgttagccagctgtaccaacctgagaaccatctagggctgcatcaagcagaacccgctgaaattaagtacgattacttaatcagtgctgtaggtgccgaacctaacacatttggtattcctggggtgactgattacggtcatttcttcgaggaaattcccaacagcttggaaatcagaagaacctttgccgccaatctagaggaggccaacctgctgcctaagggtgatcccgaaagaagaagactactgagcattgtcgtcgtgggcggagggcctacaggcgtggaggccgctggcgagctacaggactatgttcaccaggacctgagaaagtttctccccgccttggccgaggaagtgcaaattcacctggtcgaagctctgcccatcgttctgaacatgtttgagaaagagctttcatcatacgcgcaaagccatttagaaaacacttcgatcaaagtacatctgagaaccgctgtcgccaaggtggaagaaaagcaattgttggcaaagaccaaacacgaggacggtaaaataaccgaagaaaccatcccatacggtactttgatttgggccaccggtaacaaggccagaccggtgatcactgaccttttcaagaaaattcctgagcagaactcgtccaagcggggcttggcagtgaacgactttctgcaggtggagggcagcaacaacattttcgccatcggcgacaatgcatttagcgggttgcctccaaccgcccaagtagcgcaccaagaggccgaatacatcgccaagaattttgataaaatggcccagataccaaatttccaaaagaatctatcctcaagaaaggataaaattgatctcttgttcgaggagaacaactttaaacctttcaaatacaacgatctgggtgccttagcatacctgggatccgaaagggccattgcaaccatacgtagcggtaagagaaccttctacaccggtggtggcttaatgaccttctacttatggcggatcttgtacatgtccatgattctatctgccagaagcagattaaaggtctttttcgactggatcaaattagcctttttcaagagagacttctttgagggattatag

SEQ ID NO: 465 - DNA, 1542 bp, Artificial Sequence
  source: /note="Description of Artificial Sequence: Synthetic polynucleotide"
atgctgtcgaagaatttgtacagcaaccggaggctgctcacctcgacgaataccatggtcagattcgcctccaccagatccaccggggtggaaaactccggggcaggtcccacctcttttaagaccatgaaagtcattgaccctcagcacagcgacaagcccaacgtgctgatactgggctcggggtggggcgctatttcgtttttaaagcacatcgacaccaagaagtacaacgtttccatcatcagccctagaaagtatttcctgtttacccccttgttaccttctgccccagtggggaccgtagacgaaaagtccattattgagcccatcgttaatttcgctctcaagaaaaagggcaacgtcacctactatgaggcagaagccacctctatcaaccccgacaggaataccgttaccatcaagtcactgtctgccgtgagccagctataccaacctgagaaccacctaggcctgcatcaagcagagcctgctgaaattaagtacgattatttaatcagcgccgtaggtgcggaacctaacacatttggaattcccggggtcactgattacggccatttcttcaaggagatccccaactctctggaaatccggagaacttttgccgccaacctagaggaggctaacctgttgccaaagggtgaccccgaaagaagaagactgctgtccattgtcgtggttggtggtgggcctacaggtgtagaggctgctggcgaactacaggattatgttcaccaggacctgagaaagtttttccctgcactggccgaagaagtccaaattcacctggtcgaagctctgcccatcgtgctgaacatgttcgagaaagagctgtcatcatacgcccagtcacatttagaaaacacctcgatcaaagtacacctgagaacggctgtggccaaagttgaagagaagcaattgttggcaaagaccaaacacgaggacggtaaaataaccgaagaaaccattccatacggtactttgatttgggccacgggcaacaaggcaagaccggtaatcaccgacctgttcaagaaaatccctgagcaaaactcgagcaagcggggattggcagtgaacgactttttgcaggtgaaaggcagcaacaacattttcgccatcggtgacaacgcatttagcgggctgccaccaaccgcccaagtagcgcaccaagaggccgaatatatcgccaagaattttgataaaatggcccagataccaaatttccagaagaatctatcttcaagaaaggataaaattgatctgttgttcgaggaaaacaactttaagcccttcaagtacaacgacttaggtgccctggcctacctgggcagcgaaagggccattgcaaccatacgttccggtaagagaaccttctacaccggtggtggcctgatgaccttctacttatggcagattttgtacttgtccatgatcctaagcgccagatcgagattaaaggtctttttcgactggattaaattagcctttttcaaaagagacttcttcaaaggattatag

SEQ ID NO: 466 - DNA, 1542 bp, Artificial Sequence
  source: /note="Description of Artificial Sequence: Synthetic polynucleotide"
atgctatcgaagaacttgtacagtaacaagcggttgctcacctcgacgaacacgatggtgagattcgctagcaccagatccaccggggtcgaaaactccggagctggccctacatctttcaagaccatgaaagtcattgaccctcagcacagcgacaagccaaacgtgctgatactgggttcggggtggggcgctattagctttctgaagcacattgacaccaagaagtacaacgtctccatcatcagccctagaaagtatttcttacacacgcctttgttacctagcgccccagttgggaccgtagacgaaaagtcaattattgagcccatcgttaattttgctctcaagaaaaagggcaacgttacctactatgaggcagaggccaccagcatcaatcccgaccggaacaccgtgaccataaaaaacttatctgccgttagccagctataccaacccgagaaccacctagggctgcatcaagcagagcccgctgaaattaagtacgactatctgatcagcgctgtaggtgcggaacctaacacatttggaatccctggggtcaccgattacggccatttcctggaggaaattcccaactctttggaaataagaagaacttttgccgccaacctagaaaaggctaacctgctgccaaagggcgatcccgaaagaagaagactactgtccatcgtcgtggttggcggtggccctacaggtgtagaagccgctggtgaactacaggattatgtgcaccaggacctgagaaagttcttccctgcattggccgaagaagtccagattcacctggtcgaagccctgcccatcgtgttgaatatgttcgagaaggagctttcatcatacgcccaatcacatctggaaaacacttcgatcaaggtgcatctgagaacggccgtcgccaaagttgaagagaagcaactgttggccaagaccaaacacgaagacggtaaaataaccgaagaaactattccatacggtaccttgatttgggccaccggtaacaaggcaagaccggtaatcactgaccttttcaagaagattcctgagcagaacagctccaagagaggcttggcagtgaacgactttttgcaggtggagggcagcaacaacattttcgccattggcgacaacgcctttgctgggctgccacctacagcccaagtagcgcaccaagaggccgaatacttggccaagaatttcgataaaatggcccaaatccccaatttccaaaagaatctgtcttccagaaaggataaaattgacctcttgttcgaggagaacaactttaaacctttcaagtacaacgacttaggtgccttagcatacctgggatccgaaagagccattgcaaccataagatccggtaagagaacattttacaccggtggaggcctgatgaccttctacttatggcggattttgtacctgagcatgattctatctgccagaagcagactgaaggtctttttcgactggattaaaatggcatttttcaagagagacttttttaaaggcttatag

SEQ ID NO: 467 - DNA, 1542 bp, Artificial Sequence
  source: /note="Description of Artificial Sequence: Synthetic polynucleotide"
atgctatcgaagaatttgtatagcaacaagaggttgctcacctcgacgaacacgatggtcagattcgcttccaccagatccacaggggtcgaaaactccggagcaggtcctaccagctttaagaccatgaaagtcattgaccctcagcacagcgacaaaccaaacgtgctgatactgggttcggggtggggagctatcagctttttaaagcacattgacaccaagaagtacaacgttagcatcatctctcctagaaagtatttcttatttacgcctttgttacctagcgcaccagttgggaccgtagacgagaagtccattatcgagcccatcgttaactttgctctgaagaaaaaggggaacgtcacctactatgaggccgaagccacctctatcaaccccgaccggaataccgttaccatcaaatcactgtctgccgtttcccagctgtaccaacctgagaaccatctagggatgcatcaggccgaacccgctgagattaagtacgattacttaatcagcgccgtaggtgccgaacctaacacatttggaatccctggcgtcaccgattacggtcatttcttcaaggagattcccaactctctggaaataagaagaacttttgccgccaatctagagaaggccaacctgctgcctaagggtgatcccgaaagaagaagactgctgtccattgtcgtggttggtggaggccccactggcgtagaggctgctggtgaactacaggattatgttcaccaggacctgagaaagttcttccccgcattggccgaagaagtccaaattcacttggtcgaagccctgcccatcgtgttgaacatgtttgagaaaaagctttcatcatacgcccaatcacacttagaaaacacctcgatcaaagtgcatctgagaacggctgtcgccaaggttgaagaaaagcaattgctggcaaagaccaaacacgaggacggtaagataaccgaagaaactattccctacggtactttgatttgggccacgggtaacaaggcaagacccgtaatcactgaccttttcaagaaaattcctgagcagaactcgagcaagagaggcctggcagtgaacgactttttgcaggtcgagggcagcaacaacatcttcgccattggcgacaatgcatttagcgggctgccacctacagcccaggtagcgcaccaagaggccgagtatatcgccaagaacttcgataaaatggcccaaataccaaatttccaaaagaacctatcctcacggaaggataaaatcgatctcttgttcgaggaaaacaactttaaacctttcaaatacaacgacctgggcgccttagcatacctgggctccgaaagggccattgcaaccatccgttccggtaagagaacattttacaccggtggtggcctgatgaccttctacttatggcagattttgtacttgagcatgatcctgtctgcccgctcgagattaaaggtgtttttcgactggatcaaaatggcatttttcaaaagagacttctttaaaggactgtag

SEQ ID NO: 468 - DNA, 1542 bp, Artificial Sequence
  source: /note="Description of Artificial Sequence: Synthetic polynucleotide"
atgctatcgaagaatttgtacagtaacaagcggttgctcacctcgacgaataccatggtgcgcttcgctagcaccagatccaccggggtcgaaaactccggagctggccctacatcttttaagaccatgaaagtcatcgaccctcagcacagcgacaaacccaacgtgctgatcctgggttctgggtggggagctatctcgtttttaaagcacattgacaccaagaagtacaacgttagcatcatctctcccagaaagtatttcttatttacccccttgctgccctctgccccagttggaacagtagacgagaagtcaattatcgagcccatcgttaactttgccctcaagaaaaaggggaacgttacctactatgaggcagaggccacctctatcaatcccgacaggaataccgttaccataaaaagcttaagcgccgtgagccagctataccaacccgaaaaccatctggggctgcatcaagcagaacccgctgagattaagtacgactatctgatcagcgctgtaggtgcggaacccaacacctttggaattcctggcgtcactgattacggccatttcctggaggaaatccccaactctttggaaatcagacggacttttgccgccaacctagaggaggctaacttactgcctaagggtgatcccgaacggagaagactactgtccattgtcgtcgtgggtggtggccctactggtgtagaagccgctggtgaactacaggattacgtgcaccaggacctgagaaagttcctccctgcattggccgaagaagtgcaaattcacttggtggaagctctgcccatcgttttgaacatgtttgagaaagagctgagctcatacgcgcaaagccacttagaaaacacttcgatcaaagtgcatctgagaaccgctgtcgccaaagttgaagagaagcaactgctggcaaagaccaaacacgaagacggtaaaattaccgaggaaactattccatacggtactttgatttgggccacgggtaacaaggccagaccggtaatcactgacctgttcaagaaaattcctgagcaaaactcgagcaagcggggattggcagtgaatgactttttgcaggtggagggcagcaacaacatcttcgccatcggtgacaatgcatttgctgggttgccaccaaccgcccaggtagcccaccaagaagccgaatatatcgccaagaactttgataaaatggctcaaataccaaatttccaaaagaacctgtcttcaagaaaggataaaatcgatctcttgttcgaggaaaacaactttaaacccttcaaatacaacgatctgggcgccttagcatacctgggcagcgaaagggccattgccaccataagatccggtaagagaaccttttacaccggtggtggcttaatgaccttctacttatggagaattttgtacatgagcatgattctgtctgcaagatcgagactgaaggtctttttcgactggatcaagatggcatttttcaaaagagacttttttgagggactgtag

SEQ ID NO: 469 - DNA, 1542 bp, Artificial Sequence
  source: /note="Description of Artificial Sequence: Synthetic polynucleotide"
atgctgagcaagaatctgtacagtaaccggcggctgctcacctcgacgaacaccctagtgagattcgctagcaccagatccacaggggtggaaaacagcggggcaggtcctacaagctttaagaccatgaaagtcattgacccccagcacagcgacaagcccaacgtgctgatactgggctctgggtggggagctatcagctttctgaagcacattgacaccaagaagtacaacgtttccatcatctctcctagaaagtatttcttacacacgcccttgttaccttctgcaccagttgggacagtggacgaaaagtcaattattgagcccatcgtgaacttcgctctcaagaaaaagggcaacgttacctactatgaggcagaagccacctctatcaaccccgacaggaacaccgttaccatcaaatcattatctgccgttagccagctgtaccagcctgaaaaccatctgggcatgcatcaagcagaacctgctgaaattaagtacgactatttaatcagtgccgtgggtgcggaacctaacacatttggtattcctggggtcactgattacggtcatttcctggaggaaatccccaactctctggaaataagaagaactttcgccgccaatctagaaaaggctaacctgttgccaaagggcgatcccgaaagaagaaggctactgagcattgtcgtcgttggcggtggccctacaggtgtggaggccgctggtgagctacaggattatgtgcaccaggacctgagaaagttcttccctgcattggccgaagaagtgcagattcacctggtcgaagccctgcccatcgttttgaatatgtttgagaaaaagcttagctcatacgcccaatcacacttagaaaacacttcgatcaaagtgcatctgagaacggctgtggccaaggtggaagaaaagcaattgctggcaaagaccaaacacgaagacggtaaaataaccgaggaaaccattccctacggtactctgatttgggccaccggcaacaaggcaagacccgtaatcactgaccttttcaagaaaattcctgagcaaaactcgagcaagagaggattggcagtgaacgacttcttgcaggtcgagggcagcaacaacattttcgccattggcgacaacgcatttgctgggttgcctccaaccgcccaagtagcgcaccaggaggccgagtatatcgccaagaatttcgacaaaatggctcaaataccaaatttccaaaagaatctatcttcaagaaaggataaaattgatctcttgttcgaggagaacaacttcaaacctttcaagtacaacgatttaggtgccctggcatacctgggatccgaaagagccattgcaaccatacgtagcggtaagagaacattttacaccggtggaggcttaatgaccttctacttatggcggattctgtacatgagcatgattctatctgcacgcagcagattaaaggtctttttcgactggattaaattagccttcttcaaaagagactttttcgagggcttatag

SEQ ID NO: 470 - DNA, 1542 bp, Artificial Sequence
  source: /note="Description of Artificial Sequence: Synthetic polynucleotide"
atgctaagcaagaatttgtatagtaacaagcggttgctcacctcgacgaacaccatggtcagattcgcttccaccagatccacaggggtcgaaaactccggagcaggtcctacaagctttaagaccatgaaagtcattgaccctcagcacagcgacaaaccaaacgtgctgatactgggttcggggtggggagctatttcgtttttaaagcacatcgacaccaagaagtacaacgtttccatcatctctcctagaaagtatttcttatttacgcctttgttacccagcgcaccagttgggacagtagacgaaaagtcaattattgagcccatcgttaatttcgccctgaagaaaaaggggaacgtcacctactatgaggcagaggccacctctatcaatcccgaccggaataccgttaccatcaagaacctgtctgccgtgagccagctgtaccaacctgaaaaccatctgggcatgcaccaagcagaacccgctgaaattaagtacgactatttaatcagtgccgtaggcgcggaacccaacacctttggtatccccggcgtgactgattacggtcatttcctgaaggaaattcccaactctttggaaatcagaagaacttttgccgccaatctagaggaggctaacttattgccaaagggtgatcccgaaagaagaaggctactgagcattgtcgtggttggcggtgggcctacaggtgtagaagccgctggcgaactgcaggactacgttcaccaggacctgagaaagtttttccctgcattggccgaggaagtccaaattcacttggtcgaagctctgcccatcgttttgaatatgttcgagaagaagctttcaagctacgcgcaatcacacctggaaaacacctcgatcaaggtacacctgagaacggccgtcgccaaagttgaagagaagcaattgctggcaaagaccaagcacgaagacggcaaaataaccgaagaaaccatcccatacggtactttgatttgggccaccggcaacaaggccagaccggtaatcactgaccttttcaagaagatccctgagcaaaactcgagcaagagaggcttggccgtgaatgacttcttgcaggtgaaaggcagcaacaacattttcgccattggcgacaatgcatttgctggcctgccacctaccgcccaagtggcccaccaggaggccgaatatatcgccaagaattttgataaaatggctcaaataccaaatttccagaagaatctatcttccagaaaggataagattgacctcttgttcgaggagaacaacttcaaacctttcaagtacaacgacctgggtgccttagcatacctgggcagcgaaagggccattgccaccataagaagcggtaagcggaccttctacaccggtggtggcttaatgaccttctacctgtggcagattctgtacatgtccatgattctatctgcaagaagcagactgaaggtctttttcgactggatcaagatggcatttttcaaaagagacttctttaagggattatag

SEQ ID NO: 471 - DNA, 1542 bp, Artificial Sequence
  source: /note="Description of Artificial Sequence: Synthetic polynucleotide"
atgctatcgaagaatttgtatagtaaccggcggttgctgacctcgacgaacacgctagtccgcttcgcttccaccagatccacaggcgtcgaaaactccggagcaggtcctacctctttcaagaccatgaaagtcatcgaccctcagcacagcgacaaacccaacgtgctgatactgggttcggggtggggagccatctcgtttttaaagcacattgacaccaagaagtacaacgttagcatcatctctcctagaaagtatttcctgttcacgcccctgatgccttctgcaccagttgggaccgtagacgagaagtccattatcgagcccatcgtgaatttcgctctgaagaaaaaggggaacgttacctactatgaggcagaagccacctctatcaatcccgacaggaataccgtgaccataaaaaacttatctgccgttagccagctgtaccaacctgaaaaccatctgggcatgcaccaggccgaacctgctgagattaagtacgactatttaatcagtgccgtaggcgcggagcccaacacatttggtattcctggggtgactgattacggtcatttcttcaaggaaattcccaacagcttggaaatacggcggactttcgccgccaatctagaggaggctaacttactgccaaagggtgatcccgaacggagaagactactgtccattgtcgtcgtgggtggtggccctactggtgtagaggccgctggtgagctacaggattacgttcaccaggacctgcggaagtttctgcccgccttggccgaggaagtccagattcacttggtcgaagctctgcccatcgttttgaatatgttcgagaagaagctttcatcatacgcccaaagccatctggaaaacacttccatcaaagtgcatctgagaacggctgtcgccaaagttgaagaaaagcagttgttggcaaagaccaaacacgaggacggtaaaattaccgaagaaactattccatacggcactctgatttgggccaccggcaacaaggcaagaccggtgatcactgaccttttcaagaaaatccctgagcaaaactcgtccaagagaggattggcagtgaatgactttttgcaggtgaaaggcagcaacaacattttcgccattggcgacaacgcatttagcggcttgcctcctaccgcccaagtggcgcaccaagaggccgaatatatcgccaagaattttgacaagatggctcagatccccaatttccaaaagaacctatcttcaagaaaggataaaattgacctcttgttcgaggagaacaactttaagcctttcaaatacaacgatctgggtgccttagcatacctgggatccgaaagggccattgcaaccatccgttccggtaagagaacattttacaccggtggtggcttaatgaccttctacttatggagaattttgtacttgagcatgatcctaagcgcccgctcgagactgaaggtcttcttcgactggatcaaaatggcattcttcaagagagacttttttaaaggcctgtga

SEQ ID NO: 472 - DNA, 1542 bp, Artificial Sequence
  source: /note="Description of Artificial Sequence: Synthetic polynucleotide"
atgctaagcaagaatttgtacagtaacaagaggttgctcacctcgacgaacacgatggtcagattcgcttccaccagatccacaggggtggaaaactccggagctggtcctacatcttttaagaccatgaaagtcattgaccctcagcacagcgacaaaccaaacgtgctgatactgggctcgggctggggcgctatttcgtttttaaagcacattgacaccaagaagtacaacgtttccatcatctctcctagaagctatttcttacacacgcccttgatgcctagcgcaccagttgggaccgtggacgagaagtcaattattgagcccatcgtgaatttcgctctcaagaaaaaggggaacgttacctactatgaggccgaagccacctctatcaaccccgacaggaacaccgtgaccataaagtcactgagcgccgttagccagctgtaccagcctgaaaaccacctagggatgcaccaagcagaacctgctgaaattaagtacgactatttaatcagtgctgtaggtgcggaacccaacacctttggtattcctggggtcactgactacggtcatttcctgaaagaaattcccaacagcttggaaatacggagaaccttcgccgccaatctagaggaggccaacttactgcctaagggcgatcccgagcggagaagactactgagcatcgtggtggttggtggtggccctacaggtgtggaggctgctggtgagctacaggattatgttcaccaggacctgagaaagtttctccccgccttggccgaagaagtccaaattcacttggtcgaagctctgcccatcgttttgaatatgtttgagaagaagcttagctcatacgcgcaatcacatttagaaaacacttccatcaaagtacacctgagaaccgctgtggccaaggttgaagaaaagcagctgttggcaaagaccaaacacgaagacggtaaaattaccgaggaaactatcccctacggtaccttgatttgggccacgggcaacaaggcaagacccgtaatcaccgaccttttcaagaaaattcctgagcagaactcgtccaagagaggattggcagtgaatgacttcctgcaggtggagggcagcaacaacattttcgccattggtgacaatgcatttgccgggttgcctcctaccgcccaggtagcgcaccaggaagccgaatatctggccaagaattttgataaaatggcccaaataccaaatttccaaaagaatctatcttccagaaaggataagatcgatctcttgttcgaggaaaacaactttaaacctttcaagtacaacgacttaggcgccctggcctacctgggatccgaaagggccattgcaaccataagatccggtaagagaaccttttacaccggtggaggcttaatgaccttctacttatggcagattttgtacatgtccatgattctatctgcccgcagcagactgaaggtgtttttcgactggattaagatggcctttttcaagagagactttttcgagggactgtag

SEQ ID NO: 473 - DNA, 1542 bp, Artificial Sequence
  source: /note="Description of Artificial Sequence: Synthetic polynucleotide"
atgctaagcaagaatctgtatagtaacaagaggctgctcaccagcaccaatacgatggtcagattcgctagcaccagatccaccggggtggaaaactccggagctggtcccacatcttttaagaccatgaaggtcattgaccctcagcacagcgacaagccaaacgtgctgatactgggttcggggtggggagctatcagctttttaaagcacatcgacaccaagaagtacaacgtttccatcatctctcctagaaagtacttcttacacacgcctctgatgccctctgcaccagttgggacagtagacgaaaagtcaattattgagcccatcgttaactttgctctcaagaaaaaggggaacgttacctactatgaggcagaagccacctctatcaaccccgaccggaataccgtgaccataaagagcttatctgccgttagccagctataccaacctgaaaaccacctagggatgcaccaggcagagcctgctgagattaagtacgattatctgatcagtgccgtaggtgcggaacctaacacctttggtattcctggggtgaccgattacggccatttcctgaaggagatccccaactctttggaaataagaagaacttttgccgccaatctagagaaggccaacttattgcctaagggtgaccccgaaagaagaagactactgagcattgtcgtcgtgggcggagggcctactggcgtagaagccgctggtgagctacaggattatgttcaccaggacctgagaaagttcctgcctgcattggccgaagaagtccaaattcacttggtggaagctctgcccatcgttctgaatatgtttgagaaggagctttcatcatacgcgcagtcacacttagaaaacacttccatcaaagtgcacctgagaacggctgtcgccaaggttgaagaaaagcagctgctggcaaagaccaaacacgaagacggcaaaataaccgaagaaaccattccatacggtactctgatttgggccacgggcaacaaggcaagacccgtaatcactgaccttttcaagaaaatccctgagcaaaactcgagcaagagaggattggcagtgaatgactttctgcaggtgaaaggcagcaacaacattttcgccatcggcgacaacgcatttagcgggctgccaccaaccgcccaagtagcgcaccaggaggccgagtacttggccaagaactttgacaagatggcccagatacccaatttccaaaagaatctgtcttcacggaaggataagattgatctcttgttcgaggagaacaacttcaaacctttcaaatacaacgatttaggcgccttagcctacctgggctccgaaagggccattgccaccatacgttccggtaagagaaccttttacaccggcggaggcttaatgaccttctacttatggcagatcttgtacatgtccatgattctgtctgcaagatcgagattaaaggtgtttttcgactggattaaaatggcatttttcaaaagggacttttttaaaggactgtga

SEQ ID NO: 474 - DNA, 1542 bp, Artificial Sequence
  source: /note="Description of Artificial Sequence: Synthetic polynucleotide"
atgctatcgaagaatttgtatagtaacaagaggttgctgacctcgacgaacacgctagtccgcttcgcctccaccagatccacaggcgtggaaaacagcggggctggtcccacatcttttaagaccatgaaggtcatcgaccctcagcacagcgacaaacccaacgtgctgatcctgggctcggggtggggcgctattagctttttaaagcacattgacaccaagaagtacaacgtttccatcatcagccctagaaagtacttcttatttacgcctttgttacctagcgcaccagtggggacagtagacgagaagtcaatcatcgagcccatcgttaatttcgccctgaagaaaaaggggaacgttacctactatgaggcagaagccacctctatcaatcccgacaggaataccgttaccatcaagtcactgtctgccgtttcccagctataccaacctgagaaccacctaggcctgcatcaggccgaacccgccgagattaagtacgattatttaatcagtgctgtaggtgccgaacctaacacatttggaattcctggcgtgactgattacggtcatttcttcaaggaaattcccaactctttggaaataagaagaacttttgccgccaatctagaagaggctaacctgttgccaaagggtgaccccgaacggagaaggctactgtccattgtcgtcgttggtggtgggcccactggtgtagaagctgctggtgaactgcaggactatgttcaccaggacctgagaaagttcttccccgcattggccgaagaagtccaaattcacttggtggaagccctgcccatcgttctgaatatgtttgagaaagagctttcatcatacgcgcaatcacatttagaaaacacttcgatcaaagtacacctgagaacggctgtcgccaaagtggaagaaaagcaactgttggcaaagaccaaacacgaggacggtaaaataaccgaagaaactattccctacggcactctgatttgggccaccggtaacaaggcaagaccggtaatcactgaccttttcaagaagattcccgagcagaacagcagcaagagaggattggcagtgaacgactttttgcaggtggagggcagcaacaacattttcgccattggtgacaacgcctttagcgggttgccacctaccgcccaagtagcgcaccaagaggccgaatacctggccaagaattttgacaaaatggctcaaataccaaatttccaaaagaatctatcttcacggaaggataagattgacctcttgttcgaggaaaacaactttaagcctttcaaatacaacgatctgggtgccttagcctacctgggctccgaaagagccattgcaaccatccgtagcggtaagagaacattttacaccggtggtggcttaatgaccttctacttatggcagattttgtacatgagcatgattctatctgccagatcgagattaaaggtcttcttcgactggattaaattagccttcttcaagagagacttctttgagggcttatga

SEQ ID NO: 475 - DNA, 1542 bp, Artificial Sequence
  source: /note="Description of Artificial Sequence: Synthetic polynucleotide"
atgctatcgaagaatttgtacagtaacaagaggttgctcacctcgacgaacaccatggtcagattcgcttccaccagatccacaggcgtggaaaacagcggggctggtcctacaagctttaagaccatgaaagtcattgaccctcagcacagcgacaaacccaacgtgctgatactgggctcgggctggggagctattagctttttaaagcacattgacaccaagaagtacaacgtttccatcatctctcctagaaagtacttcttatttacgcccttgatgcctagcgcaccagttgggacagtagacgagaagtcaattattgagcccatcgttaactttgctctcaagaaaaagggcaacgttacctactacgaggcagaggccacctctatcaatcccgaccggaataccgtgaccataaaatcattaagcgccgtgtcccagctataccagcctgaaaaccacctaggcctgcatcaagcagaacccgctgaaattaagtacgattatctgatcagtgccgtgggtgcggaacccaacacatttggtattcctggggtgactgattacggccatttcctggaggagattcccaactctttggaaatacggagaactttcgccgccaatctagaagaggccaacttattgcctaagggtgaccccgaacggagaaggctgctgagcatcgtcgtcgtgggcggtgggcctactggcgtagaggctgctggtgaactgcaggactatgtgcaccaggacctgagaaagttcctccccgcactggccgaagaagtccaaattcacttggtcgaagctctgcccatcgttttgaacatgttcgagaaagagctttcatcatacgcgcaaagccatctggaaaacacttccatcaaagtgcatctgagaacggctgtcgccaaagttgaagaaaagcagttgttggccaagaccaagcacgaagacggtaaaattaccgaggaaactattccatacggcaccttgatttgggccacgggtaacaaggcaagaccggtaatcactgaccttttcaagaaaattcctgagcaaaactcgtccaagagaggactggcagtgaacgactttctgcaggtcgagggcagcaacaacattttcgccattggtgacaacgcctttagcggcttgccaccaacagcccaagtagcgcaccaagaggccgaatacctggccaagaactttgataaaatggctcaaatacccaatttccaaaagaatctatcttcacggaaggataaaatcgatctcttgttcgaggagaacaacttcaaacccttcaaatacaacgatttaggtgccttagcatacctgggatccgaaagggccattgcaaccatacgtagcggcaagagaaccttttacaccggcggaggcctgatgaccttctacttatggagaattttgtacttgagcatgattctatctgcaagaagcagattaaaggtctttttcgactggattaagttagccttcttcaaaagagacttctttgagggattatga

SEQ ID NO: 476 - DNA, 1542 bp, Artificial Sequence
  source: /note="Description of Artificial Sequence: Synthetic polynucleotide"
atgctatcgaagaatttgtatagtaacaagaggttgctcacctcgacgaatacgatggtccgcttcgcctccaccagatccacaggggtggaaaacagcggagcaggccctaccagcttcaagaccatgaaggtcattgacccccagcacagcgacaagccaaacgtgctgatactgggttcggggtggggagccatttcgtttttaaagcacatcgacaccaagaagtacaacgttagcatcatctctcctagaaagtacttcctgtttacgcctttgatgccttctgcaccagttggaaccgtagacgaaaagtccattattgagcccatcgttaactttgctctcaagaaaaagggcaacgttacctactacgaggccgaggccaccagcatcaaccccgacaggaataccgttaccataaaaaacctgtctgccgtgagccagctataccaacctgaaaaccatctagggctgcatcaagcagaacctgccgaaattaagtacgactatttaatcagtgctgtgggcgcggaacctaacacctttggtattcctggcgtcactgattacggccatttcctggaggaaattcccaactctttggaaataagaagaacttttgccgccaacctagaagaggccaacttactgccaaagggcgatcccgaaagaagaaggctgctgagcattgtggtggtgggtggtgggcctactggcgtagaggccgctggtgagctacaggattacgtgcaccaggacctgcggaagtttttccccgcattggccgaagaagtccaaattcacctggtggaagctctgcccatcgtgttgaatatgtttgagaaaaagctttcatcatacgcccaatcacacttagaaaacacttcgatcaaggtgcatctgagaaccgctgtggccaaagttgaagaaaagcaattgttggcaaagaccaaacacgaagacggtaagattaccgaggaaaccattccatacggtactctgatttgggccacgggtaacaaggcaagacccgtaatcaccgaccttttcaagaaaatccctgagcaaaactcgtccaagcggggattggcagtgaatgacttcttgcaggtggagggcagcaacaacattttcgccattggcgacaatgcctttgctggcttgccacctaccgcccaagtggcgcaccaagaagccgaatatttggccaagaattttgataagatggctcagataccaaatttccaaaagaatctatcttcacggaaggataaaatcgatctgttgttcgaggaaaacaactttaaacctttcaaatacaacgatctgggtgccttagcatacctgggctccgaaagggccattgccaccatcagatccggtaagcggaccttctacaccggtggaggcctgatgaccttctacttatggcagatcttgtacctgtccatgattctatctgcacgctcgagattaaaggtcttcttcgactggatcaaaatggcatttttcaaaagagacttttttaagggattatag

SEQ ID NO: 477 - DNA, 1542 bp, Artificial Sequence
  source: /note="Description of Artificial Sequence: Synthetic polynucleotide"
atgctatcgaagaatctgtatagtaacaagaggttgctcacctcgaccaataccctcgtcagattcgcttccaccagatccaccggggtggaaaacagcggagcaggtcctaccagcttcaagaccatgaaagtcattgacccccagcacagcgacaaaccaaacgtgctgatcctgggttcgggctggggcgctattagctttctgaagcacattgacaccaagaagtacaacgttagcatcatctctcctagaaagtatttcttatttacgcctctgatgccctctgccccagttggaacagtagacgaaaagtccattattgagcccatcgttaattttgccctcaagaaaaaggggaacgttacctactatgaggcagaagccacctctatcaaccccgaccggaataccgttaccataaagaacttaagcgccgtgtcccagctataccagcctgagaaccatctagggatgcaccaagcagagcctgctgaaattaagtacgattatttaatcagtgctgtaggtgccgagcccaacacctttggtattcccggcgtcactgattacggtcatttcctgaaagagattcccaactctttggaaatacggcggactttcgccgccaatctagaaaaggctaacttattgccaaagggcgatcccgaaagaagaaggctactgtccattgtcgtggtgggtggaggccctactggtgtggaggccgctggcgaactacaggactatgttcaccaggacctgagaaagttcttccccgcattggccgaagaagtccaaattcacctggtcgaagccctgcccatcgttttgaacatgttcgagaaggagctttcatcatacgcccaatcacatctggaaaacacttcgatcaaagtacatctgagaacggctgtcgccaaagttgaagaaaagcaactgttggccaagaccaagcacgaagacggtaaaataaccgaagaaactatcccctacggtactttgatttgggccacgggcaacaaggcaagacccgtaatcactgaccttttcaagaaaattcccgagcagaactcgtccaagcggggattggcagtgaatgactttttgcaggtcaaaggcagcaacaacattttcgccatcggtgacaatgcatttagcggcctgccaccaacagcccaagtagcccaccaagaggccgaatacttggccaagaattttgataagatggctcaaataccaaatttccagaagaatctatcttcaagaaaggataagattgatctcttgttcgaggaaaacaactttaaacctttcaaatacaacgatttaggcgccttagcatacctgggatccgaaagggccattgccaccatcagatccggtaagagaacattctacaccggtggtggcttaatgaccttctacctgtggcggattttgtacatgtccatgattctatctgcacgctcgagactgaaggtcttcttcgactggattaagatggcattcttcaagagggactttttcaaaggattatag

SEQ ID NO: 478 - DNA, 1542 bp, Artificial Sequence
  source: /note="Description of Artificial Sequence: Synthetic polynucleotide"
atgctatcgaagaatttgtatagtaacaagaggctgctcacctcgacgaacacgatggtcagattcgcctccaccagatccacaggggtggaaaactccggagctggtcccaccagctttaagaccatgaaagtcattgacccccagcacagcgacaaaccaaacgtgctgatactgggttcgggctggggcgctattagctttttaaagcacattgacaccaagaagtacaacgtttccatcatctctcccagaagctatttcctgcacacccctttgatgccttctgcccctgtggggacagtggacgaaaagtccatcattgagcccatcgttaattttgctctcaagaaaaaggggaacgttacctactatgaggcagaggccacctctatcaatcccgacaggaacaccgtgaccatcaagtcattaagcgccgtttcccagctataccaacctgaaaaccatctggggatgcatcaggcagaacctgctgagattaagtacgattatttaatcagtgctgtgggcgcggagcctaacacctttggtattcctggggtcactgactacggtcatttcctgaaagagatccccaactctttggaaatacggcggactttcgccgccaatctagaagaggccaacctgctgccaaagggtgatcccgaaagaagaaggctactgtccattgtcgtggttggtggtggccctactggtgtagaggccgctggtgaactgcaggactacgtgcaccaggacctgcggaagtttctccccgcattggccgaagaagtgcaaattcacttggtggaagctctgcccatcgtgctgaatatgtttgagaaagagctgagctcatacgcgcaatcacatttagaaaacacttcgatcaaagtacatctgagaacggctgtggccaaggttgaagaaaagcagttgctggcaaagaccaaacacgaagacggcaaaattaccgaagaaaccattccatacggtactttgatttgggccacgggtaacaaggcaagacccgtaatcaccgacctgttcaagaaaattcctgagcagaacagcagcaagagaggcttggcagtgaacgactttttgcaggtcaaaggcagcaacaacatcttcgccattggtgacaatgcctttgctggcctgccaccaaccgcccaagtagcccaccaagaagccgaatatttggccaagaattttgataaaatggcccaaataccaaatttccaaaagaacctatcttccagaaaggataagatcgatctcctgttcgaggaaaacaacttcaaacccttcaaatacaacgatttaggcgccttagcctacctgggatccgaaagggccattgcaaccataagatccggtaagagaacattttacaccggtggaggcttaatgaccttctacttatggcagatcttgtacatgtccatgatcctatctgcacgctcgagattaaaggtctttttcgactggattaaaatggcatttttcaaaagggacttttttgagggattatag

SEQ ID NO: 479 - DNA, 1542 bp, Artificial Sequence
  source: /note="Description of Artificial Sequence: Synthetic polynucleotide"
atgctaagcaagaacttgtacagtaacaagaggctgctgacctcgacgaatacgctcgtcagattcgcctccaccagatccacaggggtcgaaaactccggagcaggtcctacaagctttaagaccatgaaagtcattgaccctcagcacagcgacaaacccaacgtgctgatactgggctctgggtggggagctatttcgtttctgaagcacattgacaccaagaagtacaacgtctccatcatcagccctagaaagtatttcttatttacgcccttgttaccttctgcacctgttggaacagtggacgaaaagtcaattatcgagcccatcgttaatttcgctctcaagaaaaaggggaacgttacctactacgaggccgaagccaccagcatcaatcccgacaggaataccgttaccatcaagaacttaagcgccgtttcccagctataccaacctgagaaccacctagggatgcaccaggccgagcctgccgaaattaagtacgattacttaatcagcgctgtaggcgcggaacctaacacctttggaattcccggggtcactgattacggtcatttcttcgaggaaattcccaactctctggaaataagaagaacttttgccgccaacctagagaaggctaacttattgccaaagggtgatcccgaacggagaagactactgtccattgtggtggttggcggtgggcctactggtgtagaagccgctggcgagctacaggattacgttcaccaggacctgagaaagtttttccctgcactggccgaagaagtccaaattcacttggtggaagctctgcccatcgttctgaacatgttcgagaaagagctttcaagctacgcgcaaagccacttagaaaacacctcgatcaaagtgcatctgagaacggctgtcgccaaggttgaagagaagcaattgttggcaaagaccaagcacgaagacggtaagattaccgaggaaactattccctacggtaccctgatttgggccaccggtaacaaggcaagacccgtaatcactgaccttttcaagaagattcctgagcaaaacagctccaagagaggcttggcagtgaatgactttttgcaggtgaaaggcagcaacaacattttcgccattggcgacaatgcatttagcgggctgccacctacagcccaagtagcccaccaagaggccgaatacttggccaagaattttgataaaatggctcaaataccaaatttccaaaagaatctgtcctcaagaaaggataaaattgacctcctgttcgaggagaacaactttaaacctttcaagtacaacgacttaggtgccctggcatacctgggatccgaaagggccattgcaaccataagaagcggtaagagaacattttacaccggtggaggcttaatgaccttctacttatggagaattttgtacatgtccatgatcctgtctgcaagaagcagattaaaggtctttttcgactggattaagatggcctttttcaagagggacttttttaaaggattatga

SEQ ID NO: 480 - DNA, 1542 bp, Artificial Sequence
  source: /note="Description of Artificial Sequence: Synthetic polynucleotide"
atgctatcgaagaatttgtatagtaaccggaggctgctgaccagcaccaatacgatggtcagattcgcttccaccagatccacaggcgtcgaaaactccggggcaggtcccacctcttttaagaccatgaaagtcattgaccctcagcacagcgacaaacccaacgtgctgatcctgggctctggctggggagctatttcgtttctgaagcacattgacaccaagaagtacaacgtttccatcatctctcctagaaagtacttcctgtttacgcctttgatgccctctgcacctgttgggacagtagacgagaagtcaattattgagcccatcgttaactttgctctcaagaaaaagggcaacgttacctactacgaggcagaagccacctctatcaatcccgacaggaataccgttaccataaaaaacttaagcgccgtgagccagctataccagcctgaaaaccatctaggcctgcatcaagccgaacccgccgaaattaagtacgattacttaatcagtgctgtgggcgcggaacctaacacatttggaattcctggcgtcactgattacggtcatttcttcaaagaaattcccaactctctggaaatcagacggacttttgccgccaatctagagaaggctaacctgctgcctaagggtgatcccgaacggagaagactactgtccattgtggtcgttggcggtggccccactggtgtagaagctgctggtgaactacaggattacgttcaccaggacctgcggaagttcctccccgccttggccgaggaagtgcaaattcacctggtggaagccctgcccatcgttttgaatatgtttgagaaagagctttcatcatacgcgcagtcacatttagaaaacacttcgatcaaggtgcatctgagaacggctgtcgccaaagtggaagagaagcaattgctggcaaagaccaaacacgaagacggtaaaattaccgaggaaactattccctacggtactttgatttgggccacgggtaacaaggcaagaccggtaatcaccgaccttttcaagaaaattcctgagcaaaactcgtccaagagaggattggcagtgaatgactttttgcaggtggagggcagcaacaacattttcgccattggcgacaatgcatttgctggcttgccacctacagcccaagtagcccaccaagaggccgaatatctggccaagaactttgataaaatggctcaaatacccaatttccaaaagaacctgtcttcaagaaaggataaaattgacctcttgttcgaggagaacaactttaaacctttcaaatacaacgatctgggtgccctggcatacctgggatccgaaagagccattgccaccatccgtagcggtaagagaacattttacaccggtggaggcctgatgaccttctacttatggcagatcctgtacttgtccatgatcctatctgcccgcagcagattaaaggtctttttcgactggatcaaattagcattcttcaaaagagactttttcgagggcttatag

SEQ ID NO: 481 - DNA, 1542 bp, Artificial Sequence
  source: /note="Description of Artificial Sequence: Synthetic polynucleotide"
atgctgtcgaagaatttgtacagtaaccggaggttgctcacctcgacgaataccatggtgcgcttcgcttccaccagatccacaggcgtcgaaaactccggggcaggtcccacatcttttaagaccatgaaagtcatcgacccccagcacagcgacaagccaaacgtgctgatcctgggttcggggtggggcgctatctcgtttttaaagcacattgacaccaagaagtacaacgtttccatcatctctcctagaaagtacttcctgtttacgcccctgctgccttctgcaccagtgggaacagtggacgaaaagtccattatcgagcccatcgtgaattttgctctcaagaaaaaggggaacgttacctactacgaggcagaagccaccagcatcaatcccgacaggaacaccgtgaccataaaaagcttatctgccgttagccagctgtaccaacccgaaaaccatctaggcatgcaccaagcagaacctgccgagattaagtacgactatttaatcagtgctgtgggtgccgaacctaacacatttggtatccctggggtcactgattacggtcatttcttcgaggaaattcccaacagcttggaaatacggcggactttcgccgccaatctagaggaggccaacttattgccaaagggcgatcccgaaagaagaagactactgtccatcgtggtggttggtggagggcctactggcgtggaggccgctggtgagctgcaggactatgtgcaccaggacctgagaaagttcctccccgcattggccgaggaagtccaaattcacttggtggaagctctgcccatcgttttgaacatgtttgagaagaagctttcatcatacgcgcaaagccatttagaaaacacctcgatcaaggtacatctgagaacggctgtggccaaagtggaagaaaagcaattgttggcaaagaccaaacacgaggacggtaaaataaccgaagaaaccatcccatacggtactctgatttgggccacgggtaacaaggcaagaccggtaatcaccgaccttttcaagaagattcctgagcaaaactcgtccaagagaggattggccgtgaatgacttcttgcaggtgaaaggcagcaacaacatcttcgccatcggtgacaatgcatttgctggcctgccacctacagcccaagtggcgcaccaagaggccgagtatatcgccaagaattttgataaaatggcccaaataccaaatttccaaaagaatctgtcctcaagaaaggataagattgatctcttgttcgaggaaaacaactttaagcccttcaaatacaacgatctgggcgccttagcatacctgggatccgaaagagccattgcaaccatacgttccggtaagagaaccttttacaccggtggtggcttaatgaccttctacttatggagaatcttgtacatgtccatgattctaagcgcaagatcgagattaaaggtcttcttcgactggattaagttagcatttttcaaaagagacttttttgagggcttatag

SEQ ID NO: 482 - DNA, 1542 bp, Artificial Sequence
  source: /note="Description of Artificial Sequence: Synthetic polynucleotide"
atgctaagcaagaatctgtacagcaacaagaggttgctgacctcgaccaacaccatggtgcgcttcgctagcaccagatccaccggggtggaaaacagcggagctggtcctacctctttcaagaccatgaaagtcatcgacccccagcacagcgacaaaccaaacgtgctgatcctgggttcggggtggggagccatcagctttctgaagcacatcgacaccaagaagtacaacgtctccatcatcagccccagaaagtatttcttattcacccctttgctgcccagcgccccagttggaaccgtagacgaaaagtcaattatcgagcccatcgtgaacttcgctctcaagaaaaagggcaacgttacctactacgaggccgaggccaccagcatcaatcccgaccggaacaccgttaccataaagaacttaagcgccgtgtcccagctataccaacctgagaaccacctgggcatgcaccaagccgagcctgccgagattaagtacgattatctgatcagcgccgtgggcgcggaacctaacacctttggaatccccggcgtgaccgactacggccacttcctgaaggagatccccaactctctggaaatccggagaaccttcgccgccaacctggaaaaggccaacctgctgccaaagggtgaccccgagagaagaaggctactgagcatcgtggtggttggcggagggcctactggcgtggaagccgctggtgaactacaggactatgtgcaccaggacctgcggaagttcttccccgccctggccgaagaagtccaaattcacctggtcgaagctctgcccatcgtgttgaacatgttcgagaagaagctgtcatcatacgcgcagagccacttagaaaacacctcgatcaaggtgcatctgagaacggccgtggccaaggtggaagagaagcagctgttggccaagaccaaacacgaggacggcaaaattaccgaggaaactatcccatacggcactttgatttgggccacgggcaacaaggcaagaccggtgatcaccgacctgttcaagaagatccctgagcagaacagcagcaagagaggattggccgtgaacgactttttgcaggtcgagggcagcaacaacatcttcgccattggtgacaatgcctttgctggcttgcctccaaccgcccaggtagcgcaccaggaagccgagtatatcgccaagaacttcgataagatggcccaaatacccaatttccagaagaacctgtcttcccggaaggataagatcgacctgctgttcgaggaaaacaacttcaagcctttcaagtacaacgatctgggtgccttagcatacctgggaagcgaaagagccattgccaccatcagatccggtaagcggacattctacaccggtggaggcctgatgaccttctacctgtggcagatcctgtacctgagcatgattctgagcgcaagaagcagattaaaggtgttcttcgactggattaaattagccttcttcaaaagagacttcttcgagggcttatga

SEQ ID NO: 483 - DNA, 1542 bp, Artificial Sequence
  source: /note="Description of Artificial Sequence: Synthetic polynucleotide"
atgctatcgaagaatctgtacagcaacaagcggctgctcacctcgaccaatacgatggtccgcttcgccagcaccagatccaccggcgtggaaaactccggagctggccctaccagcttcaagaccatgaaggtcatcgacccccagcacagcgacaagcccaacgtgctgatcctgggctcgggctggggagccatctcgtttttaaagcacatcgacaccaagaagtacaacgtcagcatcatctctcccagaaagtacttcttattcacgcccctgctgccctctgcacctgtggggaccgtggacgagaagtcaatcattgagcccatcgtgaacttcgccctcaagaaaaagggcaacgttacctactacgaggcagaggccacctctatcaatcccgacaggaacaccgttaccatcaaaaacttaagcgccgttagccagctgtaccagcctgagaaccacctagggatgcatcaggcagaacccgccgaaattaagtacgactacttaatcagtgccgtaggcgccgagcccaacacctttggaatccctggcgtgaccgactacggtcacttcttcgaggagatccccaactctctggaaatccggcggacttttgccgccaacctggaaaaggccaacttattgccaaagggtgaccccgagcggagaaggctactgagcatcgtggtcgttggtggaggccccactggcgtagaggctgctggcgaactgcaggactacgttcaccaggacctgcggaagttcttccccgccctggccgaggaagtccaaattcacctggtcgaagccctgcccatcgttctgaatatgttcgagaaaaagcttagcagctacgcgcaatcacacttagaaaacacctcgatcaaagtgcatctgagaacggccgtggccaaagttgaagagaagcagctgttggccaagaccaaacacgaggacggcaagattaccgaagaaactattccatacggcaccctgatttgggccacgggtaacaaggccagacccgtgatcaccgacctgttcaagaaaatccctgagcaaaacagctccaagcggggcttggccgtgaacgacttcttgcaggtcgagggcagcaacaacattttcgccattggcgacaatgcctttagcggcctgccacctaccgcccaggtagcccaccaagaagccgaatatctggccaagaacttcgacaagatggcccagatacccaatttccagaagaatctatcttcccggaaggataagattgacctgttgttcgaggaaaacaacttcaagcctttcaaatacaacgatttaggcgccctggcatacctgggaagcgaaagagccattgccaccatcagaagcggtaagagaacattctacaccggtggtggcctgatgaccttctacctgtggcggatcttgtacatgtccatgattctgagcgcccgctcgagattaaaggtgttcttcgactggatcaaactggccttcttcaagagggactttttcaaaggcctgtga

SEQ ID NO: 484 - DNA, 1542 bp, Artificial Sequence
  source: /note="Description of Artificial Sequence: Synthetic polynucleotide"
atgctgtcgaagaatctgtatagcaaccggcggctgctgacctcgaccaacaccatggtgcgcttcgccagcaccagatccacaggggtcgaaaacagcggggctggccccaccagcttcaagaccatgaaggtcatcgacccccagcacagcgacaagcccaacgtgctgatcctgggctcgggctggggagctattagctttctgaagcacattgacaccaagaagtacaacgttagcatcatctctcccagaaagtacttcttatttacccccctgctgcctagcgcccctgttggaaccgtggacgagaagtccatcatcgagcccatcgttaacttcgctctcaagaaaaaggggaacgttacctactacgaggccgaggccaccagcatcaaccccgacaggaacaccgtgaccatcaaaaacttaagcgccgtgagccagctgtaccagcctgagaaccacctgggcctgcaccaagcagagcccgctgaaattaagtacgactacttaatcagcgctgtgggcgccgagcccaacacctttggaatccccggggtgaccgactacggtcacttcttcaaggaaattcccaactctttggaaatcagaagaacttttgccgccaacctggaggaggccaacttactgcctaagggtgatcccgagcggagaaggctactgagcattgtggtcgttggtggaggccctactggcgtggaagctgctggcgagctgcaggactatgtgcaccaggacctgcggaagttcctccctgccctggccgaagaagtccaaattcacctggtcgaagctctgcccatcgttctgaatatgttcgagaaagagctgagcagctacgcccagtcacacctggaaaacacctcgatcaaagtgcacctgagaaccgctgtggccaaggtggaagagaagcaattgctggcaaagaccaagcacgaggacggtaagattaccgaggaaactattccatacggcactctgatttgggccacgggtaacaaggccagaccggtgatcactgaccttttcaagaagatccctgagcagaacagcagcaagagaggattggccgtgaatgactttctgcaggtcgagggcagcaacaacattttcgccatcggcgacaatgcatttgctgggttgcctcctacagcccaggtggcgcaccaagaggccgagtatatcgccaagaactttgacaagatggcccagatccccaatttccagaagaacctatcttcacggaaggataaaattgatctgctgttcgaggaaaacaactttaaacctttcaaatacaacgatttaggtgccctggcctacctgggcagcgaaagagccattgcaaccataagaagcggtaagcggaccttctacaccggcggtggcctgatgaccttctacctgtggcggatcctgtacttgagcatgatcctgagcgcacgcagcagattaaaggtgtttttcgactggattaagctggcctttttcaaaagggactttttcgagggactgtag

SEQ ID NO: 485 - DNA, 1542 bp, Artificial Sequence
  source: /note="Description of Artificial Sequence: Synthetic polynucleotide"
atgctatcgaagaatctgtatagcaaccggcggctgctgacctcgaccaataccatggtgcgcttcgcctccaccagatccacaggggtcgaaaacagcggggcaggccccaccagctttaagaccatgaaagtcatcgacccccagcacagcgacaagcccaacgtgctgatcctgggctcgggctggggcgccatctcgtttctgaagcacatcgacaccaagaagtacaacgtctccatcatcagccctagaaagtacttcctgttcacgcccctgatgcctagcgcccctgtgggaacagtagacgaaaagtccattattgagcccatcgttaactttgccctcaagaaaaaggggaacgttacctactacgaggcagaagccacctctatcaaccccgacaggaataccgttaccataaaaagcctgagcgccgttagccagctgtaccagcccgaaaaccatctagggctgcaccaggcagagcccgccgagattaagtacgattacctgatcagtgccgtgggtgccgagcctaacacatttggaattcccggcgtcactgattacggccatttcttcaaagagatccccaacagcctggaaatcagaagaactttcgccgccaacctagagaaggccaacctgctgccaaagggcgaccccgaacggagaaggctgctgtccattgtggtcgttggcggtgggcctactggcgtagaagctgctggcgagctacaggactacgtgcaccaggacctgcggaagtttctgcctgcattggccgaggaagtgcagattcacctggtcgaagccctgcccatcgtgctgaacatgttcgagaaggagctgagctcatacgcccagagccatctggaaaacacctccatcaaggtgcatctgagaacggccgtggccaaagtggaagaaaagcagctgttggcaaagaccaagcacgaagacggcaaaataaccgaagaaactatcccctacggtactttgatttgggccaccggcaacaaggccagacccgtgatcaccgaccttttcaagaaaatccccgagcagaacagcagcaagcggggcctggccgtgaatgactttctgcaggtcgagggcagcaacaacatcttcgccatcggtgacaacgcatttagcggcttgccaccaaccgcccaggtagcccaccaggaagccgagtatttggccaagaacttcgacaagatggcccaaatcccaaatttccagaagaacctgtcctccagaaaggataaaatcgatctgctgttcgaggaaaacaacttcaagcctttcaaatacaacgacctgggcgccctggcatacctgggcagcgaaagagccattgcaaccataagatccggtaagcggacattctacaccggtggaggcctgatgaccttctacctgtggcagatcctgtacctgagcatgattctatctgcccgcagcagactgaaggtctttttcgactggatcaagttagcctttttcaagagagacttctttaagggattatga

SEQ ID NO: 486 - DNA, 1542 bp, Artificial Sequence
  source: /note="Description of Artificial Sequence: Synthetic polynucleotide"
atgctgagcaagaacttgtatagcaacaagaggctgctcacctcgaccaacacgctagtgagattcgctagcaccagatccaccggggtcgaaaactccggagctggccccaccagcttcaagaccatgaaagtcatcgacccccagcacagcgacaagcccaacgtgctgatcctgggttctgggtggggcgccatctcgtttctgaagcacatcgacaccaagaagtacaacgtcagcatcatctctcctagaagctacttcctgttcacgcccctgatgcccagcgcccctgttgggacagtagacgagaagtcaatcattgagcccatcgttaactttgccctgaagaaaaaggggaacgttacctactacgaggcagaggccacctctatcaatcccgaccggaataccgtgaccataaagagcctgtctgccgtgtcccagctataccaacccgaaaaccacctagggctgcaccaggcagagcctgctgagattaagtacgactatctgatcagtgccgtgggtgcggaacccaacacatttggaattcctggcgtcactgactacggccacttcttcgaggagatccccaacagcctggaaatcagacggacctttgccgccaatctagaagaggccaacctgctgcctaagggtgaccccgaacggagaaggctactgagcatcgtggtggtgggtggaggccctactggtgtggaagctgctggcgagctgcaggactacgttcaccaggacctgcggaagttcctccccgccctggccgaggaagtgcagattcacctggtggaagccctgcccatcgtgttgaacatgttcgagaaagagcttagctcatacgcccagagccacctggaaaacacctcgatcaaggtacacctgagaaccgccgtggccaaggttgaagaaaagcagttgctggccaagaccaagcacgaagacggcaagataaccgaggaaactattccatacggcaccctgatttgggccaccggcaacaaggccagacccgtgatcactgacctgttcaagaagattcctgagcagaacagcagcaagagaggactggccgtgaatgacttcctgcaggtggagggcagcaacaacatcttcgccattggcgacaacgcctttgctgggctgcctccaaccgcccaagtggcccaccaagaagccgagtacatcgccaagaactttgacaagatggcccagataccaaatttccaaaagaatctgtcttcacggaaggataagatcgatctcttgttcgaggagaacaacttcaaacccttcaagtacaacgacctgggcgccttagcctacctgggatccgaaagggccattgccaccataagaagcggtaagagaaccttttacaccggcggaggcctgatgaccttctacctgtggcagatcctgtacatgagcatgattctaagcgcacgctcgagactgaaggtgttcttcgactggatcaagatggcctttttcaaaagggacttctttaaaggactgtag

SEQ ID NO: 487 - DNA, 1542 bp, Artificial Sequence
  source: /note="Description of Artificial Sequence: Synthetic polynucleotide"
atgctgagcaagaacctgtatagtaacaagcggttgctgaccagcaccaatacgatggtgcgcttcgccagcaccagatccaccggcgtcgaaaactccggggctggccccaccagcttcaagaccatgaaggtcattgaccctcagcacagcgacaagcccaacgtgctgatactgggttctggctggggagctatcagctttctgaagcacattgacaccaagaagtacaacgttagcatcatcagccctagaaagtacttcttacacacccccctgatgcccagcgcaccagtgggaacagtggacgaaaagtccatcattgagcccatcgtgaatttcgctctcaagaaaaaggggaacgtcacctactacgaggcagaggccacctctatcaaccccgaccggaataccgtgaccataaaaaacttaagcgccgtgagccagctgtaccagcccgaaaaccatctggggctgcatcaagccgagcccgccgaaattaagtacgactacctgatcagcgccgtaggcgccgagcccaacacctttggtatccctggcgtgactgattacggtcacttcctgaaggaaattcccaactctttggaaataagaagaaccttcgccgccaacctagaagaggctaacctgctgcctaagggtgatcccgagcggagaaggctgctgagcatcgtggtggtgggcggaggccccacaggcgtggaagctgctggcgaactgcaggactacgttcaccaggacctgagaaagtttctccccgccttggccgaagaagtgcaaattcacttggtcgaagctctgcccatcgttttgaatatgtttgagaagaagctgtcaagctacgcccagtcacatctggaaaacacttccatcaaggtgcacctgagaacggctgtggccaaggtggaagagaagcagctgctggccaagaccaaacacgaggacggcaagattaccgaggaaaccattccatacggtaccttgatttgggccacgggcaacaaggccagacccgtgatcaccgacctgttcaagaagatccccgagcagaactcgagcaagcggggactggcagtgaacgactttttgcaggtggagggcagcaacaacattttcgccattggtgacaacgcctttagcggcttgccaccaacagcccaagtggcccaccaagaggccgagtatctggccaagaacttcgataagatggcccagatccccaatttccagaagaatctgtcctccagaaaggataaaattgacctgttgttcgaggagaacaactttaagcccttcaagtacaacgacttaggcgccttagcctacctgggctccgaaagggccattgccaccatcagatccggtaagcggacattctacaccggcggaggcctgatgaccttctacctgtggagaatcttgtacatgtccatgatcctgtctgcccgcagcagactgaaggtcttcttcgactggattaagatggcatttttcaaaagagacttctttaagggcctgtga

SEQ ID NO: 488 - DNA, 1542 bp, Artificial Sequence
  source: /note="Description of Artificial Sequence: Synthetic polynucleotide"
atgctatcgaagaatctgtacagcaaccggcggctgctcacctcgacgaacaccatggtgcgcttcgcctccaccagatccaccggggtcgaaaactccggggctggccccacctcttttaagaccatgaaggtcatcgacccccagcacagcgacaagcccaacgtgctgatcctgggttcggggtggggagccatcagctttctgaagcacattgacaccaagaagtacaacgtctccatcatcagccccagaagctacttcttattcacgcccttgttaccctctgcccctgttgggacagtagacgaaaagtccatcatcgagcccatcgtgaactttgccctgaagaaaaagggcaacgtcacctactatgaggcagaggccaccagcatcaatcccgaccggaacaccgttaccatcaaaagcctgtctgccgtgtcccagctgtaccaacccgaaaaccacctagggctgcaccaggccgaacccgctgaaattaagtacgactacctgatcagtgccgtaggtgccgagcccaacacctttggtattcctggggtcaccgattacggtcacttcctggaggaaattcccaacagcttggaaatccggagaacctttgccgccaatctggaggaggctaacttattgccaaagggcgatcccgagcggagaaggctactgagcattgtggtcgtgggcggtggccccacaggcgtggaggccgctggcgagctgcaggattatgttcaccaggacctgcggaagttcttccccgccttggccgaggaagtccaaattcacctggtcgaagccctgcccatcgtgctgaatatgtttgagaaggagctgagcagctacgcccagtcacacctggaaaacacctcgatcaaagtgcacctgagaaccgctgtggccaaagtggaagagaagcagttgttggccaagaccaagcacgaggacggcaagataaccgaggaaactattccctacggtaccttgatttgggccacgggcaacaaggcaagaccggtaatcactgacctgttcaagaagattcctgagcaaaacagcagcaagcggggactggcagtgaacgacttcttgcaggtcgagggcagcaacaacatcttcgccatcggcgacaacgcctttgctggcctgcctcctacagcccaggtagcgcaccaggaggccgaatatctggccaagaattttgacaaaatggcccaaatccccaatttccagaagaacctgtcctcccggaaggataagattgacctgctgttcgaggaaaacaacttcaaacctttcaagtacaacgatttaggtgccctggcatacctgggcagcgaaagagccattgcaaccatcagaagcggcaagcggaccttttacaccggcggaggcttaatgaccttctacctgtggcggatcctgtacatgagcatgattctatctgcccgcagcagactgaaggtgttcttcgactggatcaagatggcatttttcaaaagggacttcttcgagggcctgtga

SEQ ID NO: 489 - DNA, 1542 bp, Artificial Sequence
  source: /note="Description of Artificial Sequence: Synthetic polynucleotide"
atgctgtcgaagaatttgtatagcaacaagaggctgctgacctcgacgaacacgctagtgagattcgccagcaccagatccacaggggtggaaaacagcggagcaggccctacaagcttcaagaccatgaaggtcatcgaccctcagcacagcgacaagccaaacgtgctgatactgggttctggctggggcgctattagctttttaaagcacatcgacaccaagaagtacaacgtcagcatcatcagccctagaaagtacttcctgcacacgcccctgctgcccagcgcacctgtgggaaccgtagacgagaagtccatcatcgagcccatcgttaacttcgccctcaagaaaaagggcaacgttacctactacgaggccgaggccacctctatcaatcccgaccggaacaccgtgaccatcaagtcactgagcgccgtttcccagctataccaacctgaaaaccacctggggctgcaccaggcagagcccgctgagattaagtacgactacctgatcagcgccgtaggtgccgagcccaacacctttggaatccccggcgtcaccgattacggtcacttcttcgaggagatccccaacagcctggaaatccggcggacctttgccgccaatctggaagaggctaacttactgcctaagggtgaccccgaaagaagaaggctactgagcatcgtggtcgtgggcggtggccccacaggtgtggaagctgctggtgagctacaggattacgtgcaccaggacctgcggaagttcctgcctgcattggccgaagaagtccagattcacctggtcgaagccctgcccatcgtgctgaacatgtttgagaaggagctgtcatcatacgcccaatcacatctggaaaacacttccatcaaagtacatctgagaaccgccgtcgccaaggttgaagagaagcaactgctggccaagaccaagcacgaggacggtaaaataaccgaggaaaccattccatacggcaccctgatttgggccaccggtaacaaggccagaccggtaatcactgacctgttcaagaagatccctgagcaaaacagcagcaagagaggcctggcagtgaacgacttcctgcaggtcaaaggcagcaacaacattttcgccatcggtgacaacgcctttagcgggctgcctccaacagcccaggtggcgcaccaagaagccgagtacatcgccaagaatttcgacaaaatggcccagataccaaatttccaaaagaacctgtcctcccggaaggataagattgacctgctgttcgaggagaacaacttcaagcctttcaagtacaacgacttaggcgccttagcctacctgggcagcgaaagagccattgccaccataagaagcggcaagagaacattttacaccggcggtggcctgatgaccttctacctgtggcagatcctgtacctgtccatgattctaagcgccagaagcagactgaaggtctttttcgactggatcaaattagcattcttcaaaagggacttcttcaaaggattatga

SEQ ID NO: 490 - DNA, 1542 bp, Artificial Sequence
  source: /note="Description of Artificial Sequence: Synthetic polynucleotide"
atgctgagcaagaacctgtacagcaacaagaggttgctgaccagcaccaacaccatggtgagattcgcctccaccagatccacaggcgtggaaaactccggagctggtcctacctcttttaagaccatgaaggtcattgacccccagcacagcgacaaaccaaacgtgctgatactgggctcgggctggggagccatctcgtttttaaagcacatcgacaccaagaagtacaacgtcagcatcatcagccctagaagctatttcctgttcacccctttgatgcctagcgcaccagttggaaccgtggacgagaagtccatcatcgagcccatcgtgaatttcgccctgaagaaaaagggcaacgttacctactacgaggccgaggccacctctatcaaccccgacaggaacaccgtgaccatcaagagcctgagcgccgtgtcccagctgtaccagcccgaaaaccatctggggctgcatcaggcagagcccgccgagattaagtacgattatctgatcagcgctgtaggtgccgagcctaacacctttggtattcctggggtcaccgactacggccatttcttcaaagagatccccaactctctggaaatccggcggaccttcgccgccaatctggaaaaggccaacctgttgccaaagggcgaccccgaacggagaaggctgctgagcatcgtggtcgtgggtggtggccccacaggcgtagaggctgctggcgagctacaggactatgtgcaccaggacctgcggaagttcttccccgcactggccgaagaagtgcaaattcacctggtcgaagctctgcccatcgtgctgaacatgtttgagaaagagctgagcagctacgcccaaagccacctggaaaacacctccatcaaggtgcacctgagaacggccgtggccaaagttgaagagaagcaattgctggccaagaccaaacacgaggacggtaagataaccgaagaaaccattccctacggcactctgatttgggccaccggcaacaaggcaagaccggtaatcaccgaccttttcaagaagattcctgagcaaaacagcagcaagcggggcttggccgtgaacgactttttgcaggtcgagggcagcaacaacattttcgccattggcgacaacgcatttagcggcttgcctcctacagcccaggtagcccaccaggaggccgagtatttggccaagaactttgataaaatggctcaaatacccaatttccagaagaatctatcctcacggaaggataagatcgatctgctgttcgaggagaacaacttcaaacccttcaagtacaacgatctgggtgccttagcctacctgggcagcgaaagagccattgccaccatcagatccggcaagcggaccttttacaccggtggaggcctgatgaccttctacctgtggcagattttgtacttgagcatgattctaagcgcccgcagcagattaaaggtgtttttcgactggatcaagatggcctttttcaagagagacttctttgagggactgtga

SEQ ID NO: 491 - DNA, 1542 bp, Artificial Sequence
  source: /note="Description of Artificial Sequence: Synthetic polynucleotide"
atgctgagcaagaacctgtacagtaaccggaggttgctgacctcgaccaacacgctcgtccgcttcgcttccaccagatccacaggcgtggaaaacagcggagcaggtcctaccagctttaagaccatgaaggtcatcgacccccagcacagcgacaagccaaacgtgctgatcctgggctctgggtggggcgctattagctttttaaagcacatcgacaccaagaagtacaacgtcagcatcatctctcctagaaagtacttcctgttcacccctttgttacccagcgcccctgttggaaccgtggacgaaaagtccattattgagcccatcgtgaacttcgccctgaagaaaaaggggaacgtcacctactatgaggccgaagccaccagcatcaatcccgacaggaataccgtgaccatcaagaacctgtctgccgtgagccagctgtaccagcccgaaaaccatctggggatgcatcaagccgagcccgccgaaattaagtacgattatctgatcagcgctgtgggtgccgagcccaacacctttggtattcccggcgtcaccgactacggtcatttcttcgaggagatccccaacagcctggaaatccggcggacctttgccgccaatctagaagaggccaacctgttgcctaagggcgaccccgagcggagaaggctactgagcattgtcgtcgttggtggtgggcctacaggtgtagaagctgctggcgaactgcaggactacgttcaccaggacctgcggaagttcctgcctgccctggccgaggaagtgcaaattcacttggtggaagccctgcccatcgttctgaacatgttcgagaaaaagctgagcagctacgcgcaaagccacttagaaaacacctccatcaaggtgcacctgagaacggctgtcgccaaggtggaagagaagcaactgttggccaagaccaaacacgaagacggcaagattaccgaggaaaccattccctacggtactctgatttgggccaccggcaacaaggccagaccggtgatcaccgaccttttcaagaaaatccccgagcagaacagcagcaagagaggattggccgtgaacgactttctgcaggtcaaaggcagcaacaacattttcgccatcggtgacaacgcctttgccgggttgcctcctaccgcccaagtggcccaccaagaggccgagtatatcgccaagaacttcgataaaatggcccagatccccaatttccagaagaatctgtcctcacggaaggataaaatcgacctgttgttcgaggagaacaactttaagcccttcaaatacaacgacctgggcgccctggcctacctgggcagcgaaagagccattgcaaccatcagatccggtaagagaacattctacaccggtggaggcctgatgaccttctacctgtggcagatcctgtacctgtccatgatcctgagcgcacgcagcagattaaaggtcttcttcgactggatcaaaatggccttcttcaagagggacttctttaaaggcttatga

SEQ ID NO: 492 - DNA, 1542 bp, Artificial Sequence
  source: /note="Description of Artificial Sequence: Synthetic polynucleotide"
atgctatcgaagaacctgtatagtaacaagcggttgctgaccagcacgaacaccctcgtgcgcttcgccagcaccagatccacaggcgtcgaaaactccggggcaggtcccacaagcttcaagaccatgaaggtcatcgaccctcagcacagcgacaagccaaacgtgctgatactgggttctggctggggagctatctcgtttttaaagcacatcgacaccaagaagtacaacgttagcatcatctctcctagaaagtacttcttacacacgcccctgctgcccagcgcaccagttggaaccgtggacgaaaagtcaatcattgagcccatcgttaacttcgccctgaagaaaaaggggaacgttacctactacgaggccgaggccaccagcatcaaccccgaccggaataccgtgaccataaagaacctgagcgccgtgtcccagctataccagcctgagaaccacctagggctgcatcaagccgagcctgctgagattaagtacgactacttaatcagtgccgtaggcgccgaacctaacacctttggtattcccggcgtgaccgactacggccacttcctggaggagatccccaactctctggaaataagacggacttttgccgccaatctggaaaaggccaacttattgcctaagggcgatcccgaacggagaaggctgctgagcattgtcgtggttggcggagggcctacaggcgtggaagctgctggtgagctacaggattacgtgcaccaggacctgcggaagttcctgcctgcattggccgaggaagtccaaattcacttggtggaagccctgcccatcgttctgaatatgttcgagaaagagctgtcaagctacgcccaatcacacttagaaaacacttccatcaaagtacatctgagaaccgctgtggccaaggttgaagagaagcagttgctggcaaagaccaaacacgaggacggcaaaattaccgaggaaaccattccctacggcaccttgatttgggccaccggcaacaaggccagacccgtgatcactgacctgttcaagaagatccccgagcaaaacagctccaagcggggattggcagtgaatgacttcctgcaggtggagggcagcaacaacatcttcgccattggcgacaacgcctttagcggcttgcctcctaccgcccaggtagcccaccaagaggccgagtacatcgccaagaacttcgacaagatggcccaaatccccaatttccaaaagaacctgtcctcacggaaggataaaatcgatctcctgttcgaggaaaacaacttcaagcctttcaagtacaacgacttaggtgccttagcctacctgggctccgaaagggccattgccaccatccgtagcggtaagcggaccttctacaccggcggaggcctgatgaccttctacctgtggcggatcttgtacatgagcatgatcctgagcgccagaagcagactgaaggtgttcttcgactggattaagctggccttcttcaaaagggacttttttgagggcctgtga

SEQ ID NO: 493 - DNA, 1542 bp, Artificial Sequence
  source: /note="Description of Artificial Sequence: Synthetic polynucleotide"
atgctaagcaagaacctgtacagcaaccggcggttgctcacctcgaccaataccctagtgcgcttcgcttccaccagatccacaggcgtggaaaacagcggggctggccccaccagcttcaagaccatgaaggtcatcgaccctcagcacagcgacaagccaaacgtgctgatactgggctctgggtggggagccatcagctttctgaagcacatcgacaccaagaagtacaacgttagcatcatcagccccagaaagtacttcttacacacgcctctgatgcccagcgcacctgttggaacagtggacgaaaagtccattatcgagcccatcgttaactttgccctcaagaaaaaggggaacgtcacctactacgaggccgaggccaccagcatcaaccccgaccggaacaccgttaccatcaaaaacctgtctgccgtgtcccagctataccaacctgaaaaccacctggggctgcatcaagccgagcctgccgagattaagtacgactacttaatcagcgctgtaggcgcggagcctaacacatttggaatccctggggtcaccgattacggtcacttcctggaggagatccccaacagcctggaaatacggcggactttcgccgccaacctagaagaggccaacctgctgcctaagggtgaccccgaaagaagaaggctactgagcatcgtcgtggttggcggtggccccacaggtgtggaggccgctggtgagctgcaggattacgttcaccaggacctgcggaagttcctccccgccttggccgaagaagtgcagattcacctggtggaagccctgcccatcgttctgaacatgtttgagaaagagctgagctcatacgcccagagccatctggaaaacacctccatcaaggtgcatctgagaaccgccgtggccaaagtggaagagaagcagctgttggcaaagaccaaacacgaagacggcaagattaccgaggaaactattccctacggcaccctgatttgggccaccggcaacaaggccagaccggtaatcactgacctgttcaagaaaatccccgagcaaaacagcagcaagcggggcctggcagtgaacgacttcctgcaggtcaaaggcagcaacaacatcttcgccattggcgacaatgcatttagcggcctgcctccaacagcccaggtggcgcaccaggaagccgagtacttggccaagaatttcgacaagatggcccagatcccaaatttccaaaagaatctgtcttcccggaaggataagatcgatctgttgttcgaggagaacaactttaagcccttcaagtacaacgacctgggcgccctggcctacctgggaagcgaaagggccattgcaaccatacgttccggcaagcggaccttctacaccggtggtggcttaatgaccttctacttatggagaatcctgtacatgagcatgatcctgtctgccagatcgagactgaaggtgtttttcgactggattaaactggcattcttcaagagagactttttcaagggactgtga

SEQ ID NO: 494 - DNA, 1542 bp, Artificial Sequence
  source: /note="Description of Artificial Sequence: Synthetic polynucleotide"
atgctgtcgaagaacctgtatagcaacaagcggttgctcacctcgaccaacaccatggtgcgcttcgctagcaccagatccaccggcgtcgaaaactccggggctggccctaccagcttcaagaccatgaaagtcatcgaccctcagcacagcgacaagccaaacgtgctgatactgggctcggggtggggcgccatcagctttttaaagcacatcgacaccaagaagtacaacgtctccatcatcagccctagaaagtacttcttacacacgcctctgatgcccagcgcccctgttggaaccgtggacgagaagtccattattgagcccatcgtgaactttgccctcaagaaaaagggcaacgtcacctactacgaggcagaggccacctctatcaatcccgaccggaataccgttaccatcaaaaacttatctgccgtgagccagctgtaccagcctgagaaccacctagggctgcaccaagccgagcccgccgagattaagtacgattacctgatcagcgctgtaggcgcggagcccaacacctttggaattcccggggtcactgattacggccacttcctggaggaaatccccaacagcctggaaatacggagaacttttgccgccaatctggaaaaggctaacttattgcctaagggcgaccccgagagaagaaggctgctgtccatcgtcgtggttggcggtggccctactggcgtagaggctgctggcgaactacaggactacgtgcaccaggacctgcggaagttcttccccgccttggccgaggaagtccagattcacctggtcgaagctctgcccatcgttctgaacatgttcgagaaggagcttagcagctacgcccaaagccacctggaaaacacctcgatcaaggtgcatctgagaacggccgtcgccaaggttgaagagaagcagctgttggccaagaccaagcacgaggacggcaaaattaccgaggaaactattccctacggcactttgatttgggccaccggcaacaaggcaagacccgtgatcactgacctgttcaagaaaatccccgagcagaactcgagcaagcggggcttggccgtgaacgacttcctgcaggtcaaaggcagcaacaacattttcgccattggcgacaatgcctttgctgggttgccacctaccgcccaagtggcccaccaagaagccgagtacctggccaagaatttcgataaaatggctcagatccccaatttccagaagaacctgtcctcccggaaggataaaatcgacctcttgttcgaggagaacaactttaagcccttcaagtacaacgacttaggcgccttagcctacctgggctccgaaagagccattgccaccatcagaagcggcaagagaaccttctacaccggtggaggcttaatgaccttctacttatggcagatcctgtacctgagcatgatcctgagcgccagatcgagattaaaggtgttcttcgactggattaaactggcctttttcaaaagagacttcttcgagggactgtga

SEQ ID NO: 495 - DNA, 1542 bp, Artificial Sequence
  source: /note="Description of Artificial Sequence: Synthetic polynucleotide"
atgctgagcaagaacttgtatagcaaccggcggctgctgacctcgacgaacaccctcgtgcgcttcgcttccaccagatccacaggggtggaaaacagcggggctggccctacaagctttaagaccatgaaagtcattgaccctcagcacagcgacaaacccaacgtgctgatcctgggctctgggtggggagctatctcgtttttaaagcacatcgacaccaagaagtacaacgtctccatcatctctcccagaaagtacttcctgtttacgcccctgctgccctctgccccagttggaacagtggacgaaaagtccattattgagcccatcgtgaattttgccctgaagaaaaagggcaacgttacctactacgaggccgaagccacctctatcaatcccgaccggaataccgttaccatcaaaagcctgtctgccgtgtcccagctgtaccaacctgagaaccacctggggatgcaccaagccgaacctgccgagattaagtacgactatctgatcagtgctgtgggcgcggagcccaacacctttggaattcccggcgtcaccgactacggccacttcttcgaggaaatccccaacagcttggaaatacggcggacttttgccgccaacctggaagaggccaacttattgccaaagggcgaccccgaaagaagaaggctgctgtccatcgtggtggtgggcggtggccccactggcgtagaagctgctggcgaactgcaggactacgttcaccaggacctgcggaagtttctccccgccctggccgaagaagtgcaaattcacctggtcgaagctctgcccatcgtgttgaacatgtttgagaagaagctttcatcatacgcccagagccatttagaaaacacctccatcaaggtgcacctgagaacggccgtggccaaagtggaagagaagcaattgctggccaagaccaagcacgaggacggcaagataaccgaggaaactattccctacggcactctgatttgggccaccggcaacaaggccagaccggtgatcaccgacctgttcaagaaaattcccgagcagaacagctccaagcggggcttggccgtgaatgacttcctgcaggtcaaaggcagcaacaacattttcgccattggcgacaatgcctttagcggcttgccacctaccgcccaggtggcccaccaggaggccgagtatatcgccaagaacttcgacaaaatggctcagatccccaatttccagaagaacctgtcctcccggaaggataagattgacctcctgttcgaggagaacaactttaagcccttcaaatacaacgacttaggcgccctggcctacctgggctccgaaagagccattgccaccatccgtagcggcaagcggacattctacaccggcggaggcttaatgaccttctacttatggcagatcctgtacctgagcatgattctgtctgcacgcagcagattaaaggtgttcttcgactggatcaagttagcatttttcaagagggacttcttcgagggcttatga

SEQ ID NO: 496 - DNA, 1542 bp, Artificial Sequence
  source: /note="Description of Artificial Sequence: Synthetic polynucleotide"
atgctgtcgaagaacctgtatagtaacaagcggctgctgaccagcaccaacaccatggtcagattcgctagcaccagatccaccggcgtggaaaactccggggcaggccccacctcttttaagaccatgaaggtcattgaccctcagcacagcgacaaacccaacgtgctgatcctgggctctgggtggggcgccatctcgtttctgaagcacatcgacaccaagaagtacaacgtctccatcatcagccccagaagctacttcctgcacacgcccttgctgcccagcgcccctgttgggaccgtggacgaaaagtcaatcatcgagcccatcgttaattttgctctcaagaaaaagggcaacgtcacctactatgaggccgaggccacctctatcaaccccgaccggaacaccgttaccataaaaaacctgtctgccgtgagccagctgtaccaacccgaaaaccacctgggcctgcaccaagccgagcctgccgagattaagtacgactatttaatcagcgccgtgggtgccgaacctaacacatttggaatccccggcgtgaccgactacggtcacttcttcgaggaaatccccaactctctggaaatacggcggaccttcgccgccaacctggaagaggccaacttactgccaaagggcgatcccgagcggagaaggctgctgtccatcgtggtggttggcggtgggcctacaggcgtagaggctgctggcgaactgcaggattacgtgcaccaggacctgcggaagttcttccctgcactggccgaagaagtgcagattcacctggtggaagctctgcccatcgtgctgaatatgttcgagaaagagctgagcagctacgcccagtcacatttagaaaacacttccatcaaggtacacctgagaaccgccgtggccaaggttgaagagaagcaattgctggccaagaccaagcacgaagacggcaagataaccgaagaaaccattccctacggcactctgatttgggccacgggcaacaaggcaagaccggtaatcaccgacctgttcaagaaaattcccgagcaaaactcgagcaagcggggactggccgtgaatgactttctgcaggtcaaaggcagcaacaacatcttcgccattggcgacaatgcctttagcggcttgcctcctacagcccaggtggcccaccaagaggccgaatacctggccaagaacttcgataagatggcccagatcccaaatttccaaaagaacctgtcctcccggaaggataaaatcgatctcttgttcgaggaaaacaacttcaagcctttcaaatacaacgatctgggcgccctggcctacctgggctccgaaagagccattgccaccatcagatccggtaagcggaccttctacaccggcggaggcctgatgaccttctacttatggcggattctgtacatgagcatgatcctaagcgcaagaagcagattaaaggtcttcttcgactggatcaaactggcattcttcaaaagagactttttcaagggattatga

SEQ ID NO: 497 - DNA, 1542 bp, Artificial Sequence
  source: /note="Description of Artificial Sequence: Synthetic polynucleotide"
atgctgagcaagaacctgtacagtaaccggcggctgctcaccagcaccaacaccatggtcagattcgcctccaccagatccaccggggtggaaaacagcggggcaggccccacaagctttaagaccatgaaggtcattgaccctcagcacagcgacaaaccaaacgtgctgatcctgggttctggctggggcgctatcagctttttaaagcacatcgacaccaagaagtacaacgttagcatcatcagccctagaaagtacttcctgcacacccctctgctgcccagcgcccctgtggggaccgtggacgagaagtccattatcgagcccatcgtgaatttcgctctgaagaaaaagggcaacgttacctactacgaggcagaggccaccagcatcaaccccgaccggaacaccgttaccataaagagcctgtctgccgtttcccagctgtaccaacccgagaaccatctgggcctgcaccaggcagagcccgccgagattaagtacgattatctgatcagcgctgtgggcgcggaacccaacacctttggaatccccggcgtgaccgattacggccacttcctgaaagagattcccaactctttggaaatcagaagaacttttgccgccaacctggaaaaggccaacctgctgccaaagggtgaccccgagcggagaagactactgtccatcgtggtcgttggtggtggccctacaggcgtggaagccgctggtgagctgcaggattatgtgcaccaggacctgagaaagttcttccccgccttggccgaagaagtgcagattcacctggtcgaagccctgcccatcgtgttgaatatgtttgagaagaagctgagctcatacgcgcagagccatttagaaaacacttcgatcaaggtacacctgagaaccgccgtcgccaaggtggaagagaagcaactgctggccaagaccaagcacgaggacggcaagattaccgaagaaaccattccatacggtaccttgatttgggccacgggcaacaaggcaagacccgtgatcactgacctgttcaagaagatccctgagcaaaactcgtccaagcggggcttggcagtgaacgacttcttgcaggtcgagggcagcaacaacatcttcgccatcggcgacaatgcctttgccggcttgccacctacagcccaggtggcccaccaggaagccgaatacatcgccaagaacttcgataaaatggctcagatacccaatttccaaaagaatctgtcttcaagaaaggataaaatcgatctcctgttcgaggaaaacaacttcaaacctttcaaatacaacgacctgggcgccctggcatacctgggctccgaaagggccattgcaaccatcagaagcggcaagagaacattttacaccggtggtggcctgatgaccttctacttatggcggattttgtacatgagcatgattctatctgcccgcagcagactgaaggtgttcttcgactggatcaagatggcattcttcaaaagagacttcttcaagggcctgtga

SEQ ID NO: 498 - DNA, 1542 bp, Artificial Sequence
  source: /note="Description of Artificial Sequence: Synthetic polynucleotide"
atgctgagcaagaacctgtacagtaacaagcggctgctcacctcgacgaacacgatggtgcgcttcgctagcaccagatccaccggcgtcgaaaacagcggagcaggccccacaagcttcaagaccatgaaggtcatcgacccccagcacagcgacaagcccaacgtgctgatcctgggctcgggctggggcgctatcagctttttaaagcacattgacaccaagaagtacaacgtcagcatcatctctcccagaaagtacttcctgttcacgcctctgatgcccagcgcccctgttggaaccgtagacgagaagtccatcatcgagcccatcgttaacttcgctctcaagaaaaaggggaacgtcacctactacgaggccgaagccacctctatcaaccccgacaggaataccgttaccataaagagcttaagcgccgtgagccagctataccagcctgaaaaccacctagggatgcatcaggccgagcctgccgagattaagtacgactacctgatcagcgctgtgggtgccgagcccaacacatttggaattcctggggtgaccgattacggccacttcttcgaggagattcccaacagcctggaaatccggagaacctttgccgccaacctggagaaggccaacctgttgcctaagggcgatcccgaacggagaagactactgtccatcgtggtcgttggtggaggccctacaggtgtagaagctgctggcgagctgcaggattatgtgcaccaggacctgagaaagttcctgcctgccctggccgaggaagtgcagattcacctggtcgaagctctgcccatcgtgctgaatatgttcgagaaaaagcttagctcatacgcccaaagccacctggaaaacacctccatcaaggtgcacctgagaacggctgtggccaaagttgaagaaaagcaattgctggcaaagaccaagcacgaagacggtaagattaccgaagaaactattccctacggcaccctgatttgggccacgggtaacaaggcaagacccgtaatcaccgacctgttcaagaagatccccgagcaaaacagcagcaagagaggattggcagtgaacgacttcctgcaggtcgagggcagcaacaacattttcgccatcggtgacaacgcatttgctggcttgccacctacagcccaagtggcccaccaggaggccgagtacatcgccaagaactttgacaagatggcccagatcccaaatttccaaaagaatctatcctcccggaaggataagatcgacctcctgttcgaggagaacaacttcaagcccttcaagtacaacgatctgggcgccttagcatacctgggcagcgaaagagccattgccaccataagaagcggcaagcggaccttctacaccggcggaggcctgatgaccttctacttatggcagattttgtacttgagcatgatcctaagcgcacgctcgagactgaaggtgtttttcgactggatcaaaatggcatttttcaagagggacttctttaaaggattatga

SEQ ID NO: 499 - DNA, 1542 bp, Artificial Sequence
  source: /note="Description of Artificial Sequence: Synthetic polynucleotide"
atgctgtcgaagaatctgtatagcaacaagcggttgctgaccagcaccaacaccctagtgagattcgcttccaccagatccaccggcgtggaaaacagcggggcaggccccacaagcttcaagaccatgaaagtcatcgacccccagcacagcgacaaacccaacgtgctgatactgggctctggctggggcgccatctcgtttttaaagcacattgacaccaagaagtacaacgtttccatcatcagccccagaaagtacttcttacacacccccctgatgcccagcgcacctgttggaaccgtagacgagaagtccatcatcgagcccatcgtgaactttgccctgaagaaaaaggggaacgtcacctactacgaggccgaggccaccagcatcaatcccgacaggaacaccgttaccatcaagaacttaagcgccgtttcccagctgtaccagcctgagaaccacctaggcatgcatcaggcagagcccgccgagattaagtacgactacctgatcagtgccgtaggcgccgagcccaacacctttggaatccccggggtgaccgactacggccacttcctggaggagattcccaacagcctggaaatcagacggaccttcgccgccaatctggaagaggctaacctgctgccaaagggtgaccccgagcggagaaggctactgtccatcgtggtcgtgggtggagggcctactggcgtagaagctgctggcgagctacaggattatgtgcaccaggacctgagaaagttcctgcctgccttggccgaggaagtgcaaattcacctggtcgaagctctgcccatcgttttgaacatgttcgagaagaagctgagctcatacgcccaatcacatctggaaaacacctccatcaaagtgcatctgagaaccgctgtcgccaaagtggaagaaaagcaactgctggccaagaccaagcacgaagacggcaaaataaccgaggaaaccattccatacggcactctgatttgggccaccggtaacaaggccagaccggtaatcaccgaccttttcaagaaaatccctgagcagaactcgagcaagagaggcttggcagtgaatgacttcctgcaggtggagggcagcaacaacatcttcgccattggtgacaatgcctttagcggcctgccacctacagcccaggtggcccaccaagaagccgagtacctggccaagaatttcgacaagatggctcaaatacccaatttccagaagaacctatcttcacggaaggataagatcgatctgctgttcgaggaaaacaactttaaacccttcaagtacaacgacctgggtgccctggcatacctgggcagcgaaagagccattgcaaccataagatccggcaagagaaccttttacaccggtggaggcttaatgaccttctacttatggagaattttgtacttgagcatgatcctgagcgccagatcgagactgaaggtctttttcgactggatcaagatggccttcttcaagagagactttttcaagggactgtga

SEQ ID NO: 500 - DNA, 1542 bp, Artificial Sequence
  source: /note="Description of Artificial Sequence: Synthetic polynucleotide"
atgctgagcaagaacttgtacagcaacaagcggttgctgaccagcacgaacaccatggtcagattcgcctccaccagatccaccggcgtggaaaacagcggagctggccccacatctttcaagaccatgaaagtcatcgaccctcagcacagcgacaagcccaacgtgctgatactgggctcggggtggggagccattagctttttaaagcacatcgacaccaagaagtacaacgtctccatcatcagccctagaagctacttcctgtttacccccctgttaccctctgcaccagttggaaccgtggacgagaagtcaatcattgagcccatcgtgaacttcgccctgaagaaaaaggggaacgtcacctactacgaggcagaggccaccagcatcaaccccgacaggaacaccgttaccataaagagcctgtctgccgttagccagctgtaccagcccgagaaccatctaggcatgcatcaagcagaacctgctgagattaagtacgactatctgatcagcgccgtgggcgccgaacccaacacatttggaattcctggggtgaccgattacggccacttcttcgaggagattcccaactctctggaaatccggagaacctttgccgccaatctggaaaaggctaacctgttgccaaagggcgaccccgaacggagaaggctgctgtccatcgtcgtcgtgggtggtgggcccactggcgtggaggctgctggtgagctgcaggactacgttcaccaggacctgcggaagtttctccccgcattggccgaggaagtgcagattcacctggtggaagccctgcccatcgttctgaacatgtttgagaagaagctgtcaagctacgcgcaatcacatctggaaaacacttcgatcaaggtgcatctgagaaccgccgtcgccaaggtggaagagaagcaactgctggccaagaccaagcacgaggacggtaagattaccgaggaaaccatcccctacggtaccttgatttgggccaccggtaacaaggcaagacccgtgatcaccgaccttttcaagaaaatccccgagcaaaactcgtccaagcggggcctggccgtgaacgacttcctgcaggtcgagggcagcaacaacatcttcgccatcggcgacaatgcatttagcggcctgcctccaacagcccaagtggcgcaccaggaggccgagtacatcgccaagaacttcgacaagatggcccagatacccaatttccagaagaacctatcttcccggaaggataaaattgacctgctgttcgaggagaacaacttcaagcccttcaagtacaacgacttaggtgccctggcctacctgggatccgaaagggccattgccaccatccgtagcggtaagcggaccttctacaccggcggaggcctgatgaccttctacctgtggcagattctgtacctgagcatgattctgtctgccagatcgagactgaaggtgtttttcgactggattaagatggcatttttcaagagagacttttttgagggcttatag

SEQ ID NO: 501 - DNA, 1542 bp, Artificial Sequence
  source: /note="Description of Artificial Sequence: Synthetic polynucleotide"
atgctgagcaagaatctgtatagtaacaagaggttgctgaccagcaccaacaccatggtgcgcttcgccagcaccagatccacaggcgtggaaaacagcggagcaggtcctaccagctttaagaccatgaaggtcattgacccccagcacagcgacaagccaaacgtgctgatcctgggttcgggctggggagctatctcgtttctgaagcacattgacaccaagaagtacaacgttagcatcatcagccctagaaagtatttcctgcacacccccctgatgccttctgcccctgtgggaacagtggacgaaaagtcaatcatcgagcccatcgtgaactttgccctgaagaaaaagggcaacgttacctactatgaggcagaggccacctctatcaatcccgacaggaacaccgttaccatcaagaacctgagcgccgtgtcccagctgtaccaacctgagaaccatctagggctgcaccaagccgagcccgctgagattaagtacgattacttaatcagcgccgtaggtgcggagcctaacacctttggaatccccggcgtgaccgactacggccatttcctgaaggagatccccaactctttggaaatacggcggaccttcgccgccaatctagaggaggccaacctgttgcctaagggtgaccccgaacggagaagactgctgagcatcgtggtggtgggcggaggccccactggtgtggaagctgctggcgagctacaggattatgtgcaccaggacctgcggaagttcctgcccgccttggccgaggaagtccaaattcacttggtggaagccctgcccatcgttctgaatatgttcgagaaagagctgagcagctacgcccaatcacacttagaaaacacctccatcaaggtgcatctgagaaccgccgtcgccaaggtggaagagaagcaactgttggccaagaccaagcacgaagacggcaaaataaccgaagaaaccattccctacggcaccctgatttgggccaccggcaacaaggccagacccgtaatcactgaccttttcaagaagatccctgagcagaactcgagcaagagaggactggccgtgaatgacttcctgcaggtggagggcagcaacaacatcttcgccattggcgacaatgcatttgccggcttgcctcctacagcccaagtggcgcaccaggaagccgagtacatcgccaagaacttcgacaagatggcccagatacccaatttccagaagaatctatcctccagaaaggataaaattgacctgttgttcgaggaaaacaacttcaagcccttcaagtacaacgacctgggtgccctggcatacctgggatccgaaagggccattgcaaccatcagatccggtaagagaaccttttacaccggcggtggcctgatgaccttctacttatggcagattctgtacctgagcatgattctgagcgcccgcagcagactgaaggtcttcttcgactggatcaagctggcattcttcaaaagggacttctttaagggattatga

SEQ ID NO: 502 - DNA, 1542 bp, Artificial Sequence
  source: /note="Description of Artificial Sequence: Synthetic polynucleotide"
atgctaagcaagaacctgtacagcaacaagcggctgctgaccagcaccaacaccatggtgcgcttcgctagcaccagatccaccggcgtggaaaacagcggggcaggccccacctctttcaagaccatgaaggtcatcgaccctcagcacagcgacaagcccaacgtgctgatcctgggctctggctggggcgccatctcgtttctgaagcacatcgacaccaagaagtacaacgttagcatcatcagccccagaagctacttcctgcacacccccctgatgcccagcgcccctgttggaaccgtggacgagaagtccatcatcgagcccatcgtgaactttgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgattacttaatcagcgccgtgggcgccgagcccaacacctttggaatccctggcgtgaccgactacggtcacttcttcgaggagatccccaacagcctggaaatccggcggaccttcgccgccaatctggaagaggccaacctgctgcctaagggcgaccccgagcggagaaggctgctgagcatcgtggtcgtgggtggaggccccacaggcgtggaagccgctggcgagctgcaggactacgttcaccaggacctgcggaagttcctgcccgccctggccgaggaagtgcagattcacctggtggaagccctgcccatcgtgctgaacatgttcgagaaggagctgtcaagctacgcccagagccacctggaaaacacctccatcaaggtgcacctgagaaccgctgtggccaaagtggaagagaagcagctgctggccaagaccaagcacgaggacggcaagattaccgaggaaactatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccattggcgacaacgcctttagcggcctgcctcctacagcccaggtggcccaccaagaggccgagtacatcgccaagaacttcgataagatggcccagatccccaatttccagaagaacctgtcctcccggaaggataagatcgacctgttgttcgaggaaaacaacttcaagcccttcaagtacaacgacctgggcgccctggcctacctgggcagcgaaagagccattgccaccatcagaagcggtaagcggaccttctacaccggcggaggcctgatgaccttctacctgtggcggattctgtacctgagcatgatcctgagcgcccgcagcagactgaaggtgttcttcgactggatcaagctggccttcttcaagagggacttcttcaagggcctgtga

SEQ ID NO: 503 - DNA, 1542 bp, Artificial Sequence
  source: /note="Description of Artificial Sequence: Synthetic polynucleotide"
atgctgagcaagaacctgtacagcaacaagaggctgctgaccagcaccaacaccctcgtgcgcttcgccagcaccagatccaccggcgtcgaaaacagcggggctggccccacaagcttcaagaccatgaaggtcatcgacccccagcacagcgacaagcccaacgtgctgatcctgggttctggctggggcgccatcagctttctgaagcacatcgacaccaagaagtacaacgtcagcatcatcagccccagaaagtacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaataccgtgaccatcaagaacctgagcgccgtgtcccagctgtaccaacctgagaaccacctgggcatgcaccaggccgagcccgccgagattaagtacgactacctgatcagcgccgtgggcgccgagcccaacacctttggaatccccggcgtgactgactacggccacttcttcaaagagatccccaacagcctggaaatccggcggaccttcgccgccaatctggaagaggccaacctgctgcctaagggcgaccccgaacggagaaggctgctgagcatcgtggtcgtgggcggaggccccacaggcgtggaagctgctggcgagctgcaggattacgtgcaccaggacctgcggaagttcctgcccgccctggccgaggaagtgcagattcacctggtggaagccctgcccatcgtgttgaacatgttcgagaagaagctgagcagctacgcccagagccatctggaaaacacctccatcaaggtgcacctgagaaccgccgtggccaaggtggaagagaagcagctgctggccaagaccaagcacgaggacggcaagattaccgaggaaaccatcccatacggcaccctgatttgggccacgggcaacaaggccagacccgtgatcactgacctgttcaagaagatccccgagcagaacagcagcaagagaggcctggcagtgaacgacttcctgcaggtcaaaggcagcaacaacatcttcgccatcggcgacaacgcctttgctggcctgcctcctacagcccaggtggcccaccaggaagccgagtatatcgccaagaacttcgacaagatggcccagatccccaatttccagaagaacctgtcctcccggaaggataagatcgacctcctgttcgaggaaaacaacttcaagcccttcaagtacaacgatctgggcgccttagcctacctgggctccgaaagagccattgcaaccatcagaagcggcaagcggacattctacaccggcggaggcctgatgaccttctacctgtggcagatcctgtacctgagcatgatcctgagcgcacgcagcagactgaaggtgttcttcgactggatcaagatggccttcttcaaaagggacttcttcaagggcctgtga

SEQ ID NO: 504 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaactccggggctggtcccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtatttcttacacacccctctgatgccctctgcccctgtgggaaccgtggacgagaagtccatcatcgagcccatcgtgaacttcgccctgaagaaaaagggcaacgtcacctactacgaggccgaggccacctctatcaaccccgaccggaacaccgtgaccatcaagaacctgagcgccgtgtcccagctgtaccagcccgagaaccacctaggcctgcaccaggccgagcccgccgagattaagtacgactacctgatcagcgccgtgggcgcggagcccaacacctttggaatccctggggtgaccgactacggccacttcttcaaagagatccccaacagcctggaaatccggcggaccttcgccgccaatctggaagaggccaacctgctgcctaagggcgaccccgaacggagaaggctgctgagcatcgtggtcgtgggcggaggccccacaggcgtggaagctgctggcgagctgcaggactacgtgcaccaggacctgcggaagttcctgcccgccctggccgaagaagtgcagattcacctggtggaagccctgcccatcgtgctgaacatgttcgagaagaagctgagcagctacgcccaaagccacctggaaaacacctccatcaaggtgcacctgagaaccgccgtggccaaggtggaagagaagcagctgctggccaagaccaagcacgaggacggcaagattaccgaggaaactattccctacggcaccctgatttgggccaccggcaacaaggccagacccgtgatcaccgacctgttcaagaagattcccgagcagaactcgagcaagcggggcctggccgtgaacgacttcctgcaggtcgagggcagcaacaacatcttcgccattggcgacaatgcctttagcggcctgcctcctacagcccaggtggcccaccaggaagccgagtacctggccaagaacttcgacaagatggcccagatccccaatttccagaagaatctgtcctcacggaaggataagattgacctgctgttcgaggaaaacaacttcaagcctttcaagtacaacgacctgggcgccctggcctacctgggcagcgaaagagccattgccaccatccgtagcggcaagcggacattctacaccggcggaggcctgatgaccttctacctgtggcggatcctgtacatgagcatgatcctgagcgcccgcagcagactgaaggtgttcttcgactggatcaagctggccttcttcaagagggactttttcaaaggcctgtga

SEQ ID NO: 505 - DNA, 1542 bp, Artificial Sequence
  source: /note="Description of Artificial Sequence: Synthetic polynucleotide"
atgctgagcaagaacctgtacagcaaccggcggctgctgaccagcaccaataccctcgtgcgcttcgcctccaccagatccaccggcgtggaaaacagcggggctggccccaccagcttcaagaccatgaaggtcatcgacccccagcacagcgacaaacccaacgtgctgatcctgggctctggctggggcgccatcagctttctgaagcacatcgacaccaagaagtacaacgtcagcatcatcagccccagaaagtacttcttattcacccccctgatgcccagcgcccctgttggaaccgtggacgaaaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactatttaatcagcgccgtgggcgccgagcccaacacctttggaatccccggggtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgttggcggaggccccacaggcgtagaagctgctggcgagctgcaggactatgtgcaccaggacctgcggaagttcttccccgccctggccgaggaagtgcagattcacctggtggaagccctgcccatcgtgctgaatatgttcgagaaggagctgagcagctacgcccagagccatctggaaaacacctccatcaaggtgcacctgagaaccgccgtggccaaggtggaagagaagcagctgctggccaagaccaagcacgaggacggcaagattaccgaagaaaccatcccctacggcaccctgatttgggccaccggcaacaaggccagacccgtgatcaccgacctgttcaagaagatccccgagcagaactcgagcaagcggggcctggccgtgaatgacttcctgcaggtcaaaggcagcaacaacatcttcgccatcggcgacaacgcatttagcggcctgcctccaacagcccaggtggcccaccaggaagccgagtacatcgccaagaacttcgacaagatggcccagatccccaatttccaaaagaacctatcctccagaaaggataaaatcgacctgctgttcgaggaaaacaacttcaagcccttcaagtacaacgacctgggtgccctggcctacctgggctccgaaagagccattgccaccatcagaagcggcaagagaaccttctacaccggcggaggcctgatgaccttctacctgtggagaatcctgtacatgagcatgatcctgagcgcccgcagcagactgaaggtgttcttcgactggatcaagatggccttcttcaagagagacttcttcgagggcctgtga

SEQ ID NO: 506 - DNA, 1542 bp, Artificial Sequence
  source: /note="Description of Artificial Sequence: Synthetic polynucleotide"
atgctgagcaagaacctgtacagcaacaagcggctgctgaccagcaccaacacgctcgtccgcttcgccagcaccagatccaccggcgtcgaaaacagcggggctggtcccaccagcttcaagaccatgaaagtcatcgacccccagcacagcgacaagcccaacgtgctgatcctgggctctggctggggcgccatcagctttctgaagcacatcgacaccaagaagtacaacgtcagcatcatcagccctagaagctacttcctgcacacccccctgatgcccagcgcccctgtgggaaccgtggacgagaagtccattatcgagcccatcgtgaatttcgccctgaagaaaaaggggaacgtcacctactacgaggccgaggccaccagcatcaaccccgaccggaacaccgtgaccatcaaaaacctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcctgaaagagatccccaacagcctggaaatccggcggactttcgccgccaacctggaaaaggccaacctgctgcctaagggtgaccccgagagaagaaggctgctgtccatcgtggtcgtgggcggagggcccacaggcgtggaagctgctggtgagctacaggactacgtgcaccaggacctgcggaagttcttccccgcactggccgaggaagtgcagattcacctggtggaagccctgcccatcgttctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcactgacctgttcaagaagatccccgagcagaacagcagcaagcggggcctggccgtgaatgacttcctgcaggtcgagggcagcaacaacatcttcgccatcggcgacaacgcatttgccggcctgcctcctacagcccaggtggcccaccaggaagccgagtatttggccaagaacttcgacaagatggcccagatccccaatttccagaagaacctgtcctcccggaaggataagatcgacctcctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctaagcgcccgcagcagactgaaggtgtttttcgactggattaagatggccttcttcaaaagggacttcttcgagggcctgtga

SEQ ID NO: 507 - DNA, 1542 bp, Artificial Sequence
  source: /note="Description of Artificial Sequence: Synthetic polynucleotide"
atgctaagcaagaacctgtacagcaacaagcggctgctgaccagcaccaacaccctcgtgcgcttcgccagcaccagatccaccggggtcgaaaacagcggggctggccccaccagcttcaagaccatgaaggtcatcgacccccagcacagcgacaagcccaacgtgctgatcctgggctctggctggggcgctatctcgtttctgaagcacatcgacaccaagaagtacaacgttagcatcatcagccccagaaagtacttcctgcacacccccctgatgcccagcgcacctgtgggaacagtggacgagaagtccatcatcgagcccatcgtgaacttcgccctgaagaaaaagggcaacgtcacctactacgaggccgaagccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtcaccgactacggccacttcttcgaggagatccccaacagcctggaaatccggagaaccttcgccgccaacctggaaaaggctaacctgctgccaaagggcgatcccgagcggagaaggctgctgagcatcgtggtcgtgggcggaggccccacaggtgtagaagccgctggcgagctgcaggactacgtgcaccaggacctgcggaagttcctgcccgccctggccgaggaagtgcaaattcacctggtggaagccctgcccatcgtgctgaacatgttcgagaaagagctgagcagctacgcccagagccacctggaaaacacctccatcaaggtgcacctgagaaccgctgtggccaaggtggaagagaagcagctgctggccaagaccaagcacgaggacggcaagattaccgaggaaaccatcccctacggcaccctgatttgggccacgggcaacaaggccagaccggtgatcaccgacctgttcaagaagatccccgagcagaacagcagcaagcggggactggccgtgaacgacttcctgcaggtcaaaggcagcaacaacatcttcgccatcggcgacaacgcctttgccggcctgcctcctacagcccaggtggcccaccaggaagccgagtacctggccaagaacttcgataagatggcccagatacccaatttccagaagaacctgtcctcccggaaggataagatcgacctcctgttcgaggagaacaacttcaagcccttcaagtacaacgacctgggcgccctggcctacctgggcagcgaaagagccattgcaaccatcagaagcggcaagcggaccttctacaccggcggaggcctgatgaccttctacctgtggcagatcctgtacatgagcatgatcctgagcgcccgcagcagactgaaggtgtttttcgactggatcaagatggccttcttcaagagggacttctttgagggcctgtga

SEQ ID NO: 508 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagccaaacgtgctgatcctgggctctggctggggcgccatcagctttctgaagcacatcgacaccaagaagtacaacgtctccatcatcagccccagaaagtacttcctgcacacgcccctgctgccctctgccccagtgggaaccgtggacgagaagtccatcatcgagcccatcgtgaacttcgccctgaagaaaaagggcaacgtcacctactacgaggccgaagccaccagcatcaaccccgaccggaacaccgtgaccatcaagagcctgagcgccgtgtcccagctgtaccagcccgagaaccacctgggcctgcaccaggccgagcccgccgagattaagtacgactacttaatcagcgccgtgggtgccgagcccaacacctttggaatccccggcgtcaccgactacggccacttcctggaggagatccccaacagcctggaaatccggcggaccttcgccgccaacctggaagaggctaacctgctgcctaagggcgaccccgagcggagaaggctgctgtccatcgtggtcgttggcggtggccccacaggcgtggaagctgctggcgaactgcaggactacgttcaccaggacctgagaaagttcctgcccgccctggccgaggaagtgcagattcacctggtggaagccctgcccatcgtgctgaatatgttcgagaagaagctgagcagctacgcccagagccacctggaaaacacctccatcaaggtgcacctgagaaccgctgtggccaaggtggaagagaagcagctgttggccaagaccaagcacgaggacggcaagattaccgaggaaaccattccctacggcaccctgatttgggccaccggcaacaaggccagacccgtgatcaccgacctgttcaagaagatccccgagcagaacagcagcaagagaggcctggccgtgaacgacttcctgcaggtcgagggcagcaacaacatcttcgccatcggcgacaacgcctttagcggcctgcctcctacagcccaggtggcccaccaggaagccgagtacatcgccaagaacttcgacaagatggcccagatcccaaatttccagaagaacctgtcctccagaaaggataagatcgacctgctgttcgaggagaacaacttcaagcccttcaagtacaacgacctgggcgccctggcctacctgggcagcgaaagagccattgccaccatcagaagcggtaagcggaccttctacaccggcggtggcctgatgaccttctacctgtggcggatcttgtacttgagcatgatcctgagcgcccgcagcagactgaaggtgttcttcgactggatcaagctggccttcttcaagagggacttcttcgagggactgtga

SEQ ID NO: 509 - DNA, 1542 bp, Artificial Sequence
  source: /note="Description of Artificial Sequence: Synthetic polynucleotide"
atgctgagcaagaacctgtacagcaacaagaggctgctgaccagcaccaacaccatggtgcgcttcgccagcaccagatccaccggcgtcgaaaacagcggggctggccccaccagcttcaagaccatgaaggtcattgacccccagcacagcgacaagcccaacgtgctgatcctgggttctggctggggcgccattagctttctgaagcacatcgacaccaagaagtacaacgtcagcatcatcagccccagaaagtacttcctgtttacccccctgctgcccagcgccccagtgggaaccgtggacgagaagtccatcatcgagcccatcgtgaacttcgctctgaagaaaaagggcaacgtcacctactacgaggccgaggccaccagcatcaaccccgaccggaacaccgtgaccatcaaaagcctgagcgccgtgtcccagctgtaccagcccgagaaccacctgggcatgcaccaggccgagcccgccgagattaagtacgactacctgatcagcgccgtgggcgccgagcccaacacctttggaatccctggcgtgaccgactacggccacttcttcgaggagatccccaacagcctggaaatccggagaaccttcgccgccaacctggaaaaggccaacctgctgcctaagggtgatcccgagcggagaaggctgctgagcatcgtggtcgtgggcggaggccccactggcgtggaagctgctggcgagctgcaggactacgtgcaccaggacctgcggaagttcctccccgccctggccgaggaagtgcagattcacctggtggaagccctgcccatcgtgctgaacatgttcgagaaggagctgagcagctacgcccagagccacctggaaaacacctcgatcaaggtgcatctgagaaccgccgtggccaaggtggaagagaagcagctgctggccaagaccaaacacgaggacggcaagattaccgaggaaaccatcccctacggcaccctgatttgggccaccggtaacaaggccagacccgtgatcaccgacctgttcaagaagatccctgagcagaacagcagcaagagaggcctggccgtgaacgacttcctgcaggtgaaaggcagcaacaacatcttcgccatcggcgacaacgcctttagcgggctgcctcctacagcccaggtggcccaccaggaagccgagtacatcgccaagaacttcgacaagatggctcaaatccccaatttccagaagaacctgtcctcccggaaggataagatcgacctgctgttcgaggaaaacaacttcaagcccttcaagtacaacgacctgggtgccctggcctacctgggcagcgaaagagccattgccaccatcagaagcggcaagcggaccttctacaccggcggaggcctgatgaccttctacctgtggcggatcttgtacatgagcatgatcctgagcgcccgcagcagactgaaggtgttcttcgactggattaagctggccttcttcaagagggacttcttcgagggcctgtag

SEQ ID NO: 510 - DNA, 1542 bp, Artificial Sequence
  source: /note="Description of Artificial Sequence: Synthetic polynucleotide"
atgctgtcgaagaacctgtacagcaacaagcggctgctgaccagcaccaacaccatggtgcgcttcgccagcaccagatccaccggcgtcgaaaacagcggggctggccccaccagcttcaagaccatgaaggtcattgacccccagcacagcgacaagcccaacgtgctgatcctgggctcgggctggggcgccatcagctttttaaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccatctgggcatgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagccgctggcgagctgcaggactatgtgcaccaggacctgcggaagttcttccccgccctggccgaggaagtgcagattcacctggtggaagccctgcccatcgtgctgaatatgttcgagaaagagctttcaagctacgcccagagccatctggaaaacacctccatcaaggtgcacctgagaaccgccgtggccaaagtggaagaaaagcagttgctggccaagaccaagcacgaggacggtaaaattaccgaggaaaccatcccctacggcaccctgatttgggccaccggcaacaaggccagacccgtgatcaccgacctgttcaagaagatccccgagcaaaacagctccaagcggggcctggccgtgaacgacttcctgcaggtgaaaggcagcaacaacatcttcgccatcggcgacaacgcctttagcggcctgccacctacagcccaggtggcccaccaggaagccgaatacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagagaacattctacaccggcggaggcctgatgaccttctacctgtggcagatcctgtacatgagcatgatcctgagcgcaagaagcagactgaaggtgttcttcgactggatcaagctggccttcttcaagagagacttctttaagggcctgtag

SEQ ID NO: 511 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggcaggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccctagaagctacttcctgcacacccctctgctgcccagcgcccctgtgggaaccgtggacgagaagtccattatcgagcccatcgttaacttcgccctcaagaaaaagggcaacgtcacctactatgaggccgaggccaccagcatcaaccccgaccggaacaccgtgaccatcaagaacctgagcgccgtgtcccagctgtaccaacccgagaaccacctgggcatgcaccaggccgaacccgccgagattaagtacgactacctgatcagcgccgtgggcgccgagcccaacacctttggtatccctggcgtgaccgactacggtcacttcttcgaggagatccccaacagcctggaaatccggcggaccttcgccgccaatctggaagaggccaacctgctgcctaagggcgaccccgagagaagaaggctgctgagcattgtggtcgtgggcggaggccccacaggcgtggaggctgctggcgagctgcaggactacgttcaccaggacctgcggaagttcttccccgccctggccgaggaagtgcagattcacctggtggaagccctgcccatcgtgctgaacatgttcgagaaaaagctgagcagctacgcccaaagccacctggaaaacacctccatcaaggtgcacctgagaaccgccgtggccaaagtggaagagaagcagctgctggcaaagaccaagcacgaggacggcaagattaccgaggaaaccatcccctacggcactctgatttgggccaccggcaacaaggccagacccgtgatcaccgacctgttcaagaaaatccccgagcagaacagcagcaagcggggcctggccgtgaacgacttcctgcaggtcaaaggcagcaacaacatcttcgccatcggcgacaacgcctttagcggcctgcctcctacagcccaggtggcccaccaggaagccgagtacctggccaagaacttcgacaagatggcccagatccccaatttccagaagaacctgtcctcacggaaggataagatcgacctgctgttcgaggaaaacaacttcaagcctttcaagtacaacgacctgggcgccctggcatacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggattaaactggccttcttcaagagggacttcttcgagggcctgtga

SEQ ID NO: 512 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatactgggctctggctggggcgccatcagctttttaaagcacatcgacaccaagaagtacaacgtctccatcatcagccccagaaagtacttcttacacacccccctgctgccctctgcccctgtgggaaccgtggacgagaagtccatcatcgagcccatcgtgaacttcgccctgaagaaaaagggcaacgtcacctactacgaggccgaggccaccagcatcaaccccgacaggaacaccgtgaccatcaagaacctgagcgccgtgtcccagctgtaccagcccgagaaccacctgggcctgcaccaggccgagcccgccgagattaagtacgattacctgatcagtgccgtgggcgccgagcccaacacctttggaatccctggcgtgaccgactacggccacttcttcaaagagatccccaacagcctggaaatccggcggaccttcgccgccaatctggaaaaggccaacctgctgcctaagggcgaccccgagcggagaaggctgctgagcattgtcgtcgtgggcggagggcccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacttccatcaaggtgcacctgagaaccgccgtggccaaggtggaagagaagcagctgctggccaagaccaagcacgaggacggcaagattaccgaagaaaccatcccctacggcaccctgatttgggccaccggcaacaaggccagacccgtgatcaccgacctgttcaagaagatccccgagcagaacagcagcaagagaggcctggcagtgaatgacttcctgcaggtcgagggcagcaacaacatcttcgccatcggcgacaacgcctttagcgggctgcctcctacagcccaggtggcccaccaggaagccgagtacatcgccaagaactttgacaagatggcccagatccccaatttccaaaagaacctgtcctcccggaaggataagatcgacctgctgttcgaggaaaacaactttaagcccttcaagtacaacgacttaggtgccctggcatacctgggcagcgaaagagccattgcaaccatcagatccggcaagcggacattctacaccggcggaggcctgatgaccttctacctgtggcggatcctgtacctgagcatgatcctgagcgcccgcagcagactgaaggtgttcttcgactggatcaagatggccttcttcaagagggacttcttcaagggcctgtga

SEQ ID NO: 513 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgctagcaccagatccaccggcgtcgaaaacagcggggctggccccacaagcttcaagaccatgaaggtcatcgacccccagcacagcgacaagcccaacgtgctgatcctgggctctggctggggcgctatcagctttctgaagcacatcgacaccaagaagtacaacgtcagcatcatcagccccagaaagtacttcctgtttacccccctgctgcccagcgcccctgtgggaaccgtggacgagaagtccattatcgagcccatcgtgaatttcgccctgaagaaaaagggcaacgtcacctactacgaggccgaggccaccagcatcaaccccgacaggaacaccgtgaccatcaagaacctgagcgccgtgagccagctgtaccaacccgagaaccacctgggcatgcaccaggccgagcccgccgagattaagtacgactacctgatcagcgccgtgggtgccgagcccaacacctttggaatccccggcgtgaccgattacggccacttcctggaggagatccccaacagcctggaaatccggcggaccttcgccgccaacctggaagaggctaacctgctgcctaagggcgaccccgagcggagaaggctgctgagcatcgtggtcgtgggtggaggccccacaggcgtagaagctgctggcgagctgcaggactacgttcaccaggacctgagaaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtcgccaaggtggaagagaagcagctgctggccaagaccaagcacgaggacggcaagattaccgaggaaaccatcccctacggtaccctgatttgggccaccggcaacaaggccagacccgtgatcaccgaccttttcaagaagatccccgagcagaacagcagcaagagaggcttggccgtgaacgacttcctgcaggtcaaaggcagcaacaacatcttcgccatcggcgacaacgcctttgccggcttgcctcctacagcccaagtggcccaccaggaagccgagtacatcgccaagaacttcgacaagatggcccagatcccaaatttccagaagaacctgtcctcccggaaggataagatcgacctgctgttcgaggaaaacaacttcaagcccttcaagtacaacgacttaggcgccctggcctacctgggcagcgaaagagccattgccaccatcagaagcggcaagcggaccttctacaccggcggaggcctgatgaccttctacctgtggcggatcctgtacatgtccatgattctgagcgcccgcagcagactgaaggtgttcttcgactggatcaagatggcctttttcaagagggacttcttcaagggcctgtga

SEQ ID NO: 514 - DNA, 1542 bp, Artificial Sequence
  source: /note="Description of Artificial Sequence: Synthetic polynucleotide"
atgctgagcaagaatctgtacagcaacaagcggctgctgaccagcaccaacacgatggtgcgcttcgcttccaccagatccaccggcgtcgaaaacagcggggctggccccaccagcttcaagaccatgaaggtcatcgacccccagcacagcgacaaacccaacgtgctgatcctgggctctggctggggcgccatcagctttctgaagcacatcgacaccaagaagtacaacgtcagcatcatcagccccagaaagtacttcctgcacacccccctgatgcccagcgcccctgtgggaaccgtggacgaaaagtccatcatcgagcccatcgtgaacttcgctctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcaaagagatccccaacagcctggaaatcagacggaccttcgccgccaacctggaagaggccaacctgttgcctaagggcgatcccgagcggagaaggctgctgagcatcgtggtcgtgggcggaggccccacaggcgtggaagccgctggcgagctgcaggactacgtgcaccaggacctgcggaagtttctgcctgccctggccgaggaagtgcaaattcacctggtggaagctctgcccatcgtgctgaacatgttcgagaaggagctgagcagctacgcccagagccacctggaaaacacctccatcaaggtgcacctgagaaccgccgtggccaaggtggaagagaagcagttgctggccaagaccaagcacgaggacggcaagattaccgaggaaaccatcccatacggcactctgatttgggccaccggcaacaaggccagacccgtgatcaccgacctgttcaagaaaatccccgagcagaacagcagcaagcggggcttggccgtgaacgacttcctgcaggtcaaaggcagcaacaacattttcgccatcggcgacaacgcatttgccggcctgcctcctacagcccaggtggcccaccaggaagccgagtacctggccaagaacttcgacaagatggcccagatccccaatttccagaagaacctgtcttcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacttatggcggatcctgtacttgtccatgatcctgagcgcccgcagcagactgaaggtgtttttcgactggatcaagctggccttcttcaagagggacttcttcgagggcttatga

SEQ ID NO: 515 - DNA, 1542 bp, Artificial Sequence
  source: /note="Description of Artificial Sequence: Synthetic polynucleotide"
atgctgagcaagaacttgtacagcaacaagcggctgctgacctcgaccaacaccctcgtgcgcttcgccagcaccagatccaccggcgtcgaaaacagcggggctggccccacaagcttcaagaccatgaaggtcatcgacccccagcacagcgacaagcccaacgtgctgatcctgggctctggctggggcgccattagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgttaacttcgccctgaagaaaaagggcaacgtcacctactacgaggccgaggccaccagcatcaaccccgaccggaacaccgtgaccatcaagagcctgagcgccgtttcccagctgtaccagcccgagaaccacctgggcatgcaccaggccgagcccgccgagattaagtacgactacctgatcagcgccgtaggcgccgagcccaacacctttggaatccccggcgtgaccgattacggccacttcttcgaggagatccccaacagcctggaaatccggcggaccttcgccgccaacctggaagaggccaacctgctgcctaagggcgaccccgagcggagaaggctgctgagcatcgtggtcgtgggcggtgggcctacaggcgtggaagctgctggcgagctgcaggactacgtgcaccaggacctgagaaagttcttccctgccctggccgaggaagtgcagattcacctggtggaagccctgcccatcgtgctgaacatgttcgagaagaagctgagcagctacgcccagagccacctggaaaacacttccatcaaggtgcacctgagaacggccgtggccaaggtggaagaaaagcagctgctggccaagaccaagcacgaggacggcaagattaccgaggaaaccatcccctacggcaccctgatttgggccaccggcaacaaggccagacccgtgatcaccgacctgttcaagaagattcctgagcagaacagcagcaagcggggcctggccgtgaacgacttcttgcaggtcgagggcagcaacaacatcttcgccatcggcgacaacgcctttgccggcctgcctcctaccgcccaggtggcccaccaggaagccgagtacctggccaagaactttgacaagatggcccagatacccaatttccagaagaacctgtcctcccggaaggataaaattgacctcttgttcgaggaaaacaacttcaagcccttcaaatacaacgacctgggcgccctggcctacctgggcagcgaaagagccattgccaccatcagaagcggcaagcggaccttctacaccggcggaggcttaatgaccttctacttatggcagatcctgtacctgagcatgatcctgagcgcccgcagcagactgaaggtgttcttcgactggatcaagctggccttcttcaagagggacttcttcgagggcctgtga

SEQ ID NO: 516 - DNA, 1542 bp, Artificial Sequence
  source: /note="Description of Artificial Sequence: Synthetic polynucleotide"
atgctgagcaagaacctgtacagcaaccggcggctgctgaccagcaccaataccctcgtgcgcttcgccagcaccagatccaccggcgtggaaaacagcggggctggccccacaagctttaagaccatgaaggtcatcgaccctcagcacagcgacaaacccaacgtgctgatcctgggctctggctggggcgccatcagctttctgaagcacatcgacaccaagaagtacaacgtcagcatcatcagccccagaaagtacttcctgttcacccccctgatgcccagcgcccctgtgggaaccgtggacgagaagtccatcatcgagcccatcgtgaacttcgccctgaagaaaaagggcaacgttacctactacgaggccgaggccaccagcatcaaccccgaccggaacaccgtgaccatcaagaacctgagcgccgtgagccagctgtaccagcctgaaaaccacctggggctgcaccaggccgagcccgccgagattaagtacgactacctgatcagcgccgtgggcgccgagcccaacacctttggaatccccggcgtgaccgactacggccatttcctggaggagatccccaacagcctggaaatccggagaaccttcgccgccaacctggaagaggccaacctgctgcctaagggcgaccccgagcggagaaggctgctgagcatcgtggtcgtgggcggagggcccacaggcgtggaagctgctggcgagctgcaggactacgtgcaccaggacctgcggaagttcctgcccgccctggccgaggaagtgcagattcacctggtggaagccctgcccatcgtgctgaatatgttcgagaagaagctgagcagctacgcccaaagccacctggaaaacacctccatcaaggtgcacctgagaaccgccgtcgccaaggttgaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaactcgtccaagcggggcctggccgtgaacgacttcttgcaggtcaaaggcagcaacaacatcttcgccatcggcgacaacgcctttagcggcctgcctcctacagcccaagtggcccaccaggaggccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacctgagcatgatcctgagcgcacgcagcagattaaaggtgttcttcgactggattaagctggccttcttcaagagggactttttcaagggcctgtga

SEQ ID NO: 517 - DNA, 1542 bp, Artificial Sequence
  source: /note="Description of Artificial Sequence: Synthetic polynucleotide"
atgctgagcaagaacctgtacagtaaccggcggctgctgaccagcaccaacaccctcgtgcgcttcgccagcaccagatccaccggcgtcgaaaacagcggggcaggccctaccagctttaagaccatgaaggtcatcgaccctcagcacagcgacaagcccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaaccgtggacgagaagtccattatcgagcccatcgtgaacttcgccctgaagaaaaagggcaacgtcacctactatgaggccgaagccaccagcatcaaccccgaccggaacaccgtgaccatcaagagcctgagcgccgtgtcccagctgtaccagcccgagaaccacctgggcatgcatcaggccgagcccgccgagattaagtacgactacctgatcagcgccgtgggcgccgagcccaacacctttggaatccccggcgtgaccgactacggccacttcttcgaggagatccccaactctctggaaatacggcggaccttcgccgccaacctggaaaaggccaacctgctgcctaagggcgaccccgagcggagaaggctgctgagcatcgtggtcgtgggcggaggccctacaggcgtggaagctgctggcgagctgcaggactacgtgcaccaggacctgcggaagttcctgcctgccctggccgaggaagtgcagattcacctggtggaagccctgcccatcgttctgaacatgttcgagaaggagcttagcagctacgcccagagccacctggaaaacacctccatcaaggtgcatctgagaaccgccgtggccaaggtggaagagaagcagctgctggccaagaccaagcacgaggacggcaagattaccgaggaaaccattccctacggtaccctgatttgggccaccggcaacaaggccagacccgtaatcaccgaccttttcaagaagatccccgagcaaaacagcagcaagcggggactggccgtgaacgacttcctgcaggtcgagggcagcaacaacattttcgccatcggcgacaacgcctttgccggcctgccacctacagcccaggtggcccaccaggaagccgagtacctggccaagaacttcgacaagatggcccagatccccaatttccagaagaacctgtcctcccggaaggataaaatcgacctgctgttcgaggaaaacaacttcaagcccttcaagtacaacgacctgggcgccctggcctacctgggaagcgaaagagccattgccaccatcagaagcggcaagcggaccttctacaccggtggaggcctgatgaccttctacctgtggcggatcctgtacatgagcatgatcctgagcgcccgcagcagactgaaggtgttcttcgactggatcaagatggccttcttcaaaagggacttcttcgagggcctgtga

SEQ ID NO: 518 - DNA, 1542 bp, Artificial Sequence
  source: /note="Description of Artificial Sequence: Synthetic polynucleotide"
atgctgagcaagaacctgtacagtaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagccaaacgtgctgatcctgggctctggctggggcgccatcagctttctgaagcacatcgacaccaagaagtacaacgtcagcatcatcagccccagaaagtacttcctgttcacccctctgatgcccagcgcccctgtggggaccgtggacgagaagtcaatcatcgagcccatcgttaacttcgccctgaagaaaaagggcaacgttacctactacgaggcagaggccaccagcatcaaccccgaccggaacaccgtgaccatcaagagcctgagcgccgtgtcccagctgtaccaacccgagaaccacctgggcatgcaccaggccgagcccgccgagattaagtacgactacctgatcagcgccgtaggcgccgagcccaacacctttggaatccccggcgtgaccgactacggccacttcctggaggaaatccccaacagcctggaaatccggcggaccttcgccgccaatctggagaaggccaacctgctgcctaagggcgaccccgagcggagaaggctgctgagcattgtggtcgtgggtggaggccccacaggcgtggaagctgctggcgagctgcaggactacgtgcaccaggacctgcggaagtttctgcccgccctggccgaggaagtgcagattcacctggtggaagccctgcccatcgtgctgaacatgttcgagaaggagcttagcagctacgcccagtcacacctggaaaacacctcgatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcactgacctgttcaagaaaatccccgagcagaacagcagcaagcggggactggccgtgaacgacttcctgcaggtcgagggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgatctgggtgccctggcctacctgggcagcgaaagagccattgccaccatcagaagcggcaagcggaccttctacaccggtggaggcctgatgaccttctacctgtggcagatcttgtacctgagcatgatcctgagcgcccgcagcagactgaaggtgtttttcgactggatcaagctggccttcttcaagagggacttcttcgagggactgtga

SEQ ID NO: 519 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgctagcaccagatccaccggcgtcgaaaacagcggagcaggccccacaagcttcaagaccatgaaggtcatcgacccccagcacagcgacaagcccaacgtgctgatcctgggctctgggtggggagccatcagctttttaaagcacatcgacaccaagaagtacaacgtctccatcatcagccccagaaagtacttcctgcacacccccctgctgcccagcgcacctgtgggaaccgtggacgagaagtccatcatcgagcccatcgtgaacttcgccctgaagaaaaagggcaacgtcacctactatgaggcagaggccaccagcatcaaccccgacaggaacaccgtgaccatcaagagcctgagcgccgtgtcccagctgtaccagcccgagaaccacctaggcatgcaccaagccgagcccgctgagattaagtacgactacctgatcagcgccgtgggcgccgagcctaacacctttggaatccccggcgtcaccgactacggccacttcctggaggagatccccaacagcctggaaatccggcggaccttcgccgccaacctggaagaggccaacctgctgcctaagggtgaccccgagcggagaaggctgctgtccatcgtcgtcgtgggtggaggccccacaggtgtggaagctgctggcgagctgcaggactacgtgcaccaggacctgcggaagttcttccccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaactatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctccaacagcccaggtggcgcaccaggaagccgagtacctggccaagaacttcgacaagatggctcagatccccaatttccagaagaacctgtcctcccggaaggataagatcgacctgctgttcgaggaaaacaacttcaagcccttcaagtacaacgacttaggcgccctggcatacctgggcagcgaaagagccattgccaccatcagaagcggcaagcggaccttctacaccggcggaggcctgatgaccttctacctgtggcggatcctgtacatgagcatgatcctgagcgcccgctcgagactgaaggtgttcttcgactggatcaagatggccttcttcaagagggacttcttcaagggcctgtga

SEQ ID NO: 520 - DNA, 1542 bp, Artificial Sequence
  source: /note="Description of Artificial Sequence: Synthetic polynucleotide"
atgctgtcgaagaatctgtacagcaaccggaggctgctgaccagcaccaacaccctcgtgcgcttcgccagcaccagatccaccggcgtcgaaaacagcggggctggccccacctctttcaagaccatgaaggtcatcgacccccagcacagcgacaagcccaacgtgctgatcctgggctcgggctggggcgccatcagctttctgaagcacatcgacaccaagaagtacaacgtcagcatcatcagccccagaaagtacttcctgttcacccccctgctgcccagcgcccctgtgggaaccgtggacgagaagtccattatcgagcccatcgtgaacttcgccctgaagaaaaagggcaacgtcacctactatgaggccgaggccaccagcatcaaccccgaccggaacaccgtgaccataaaatcactgagcgccgtgtcccagctgtaccagcctgagaaccatctaggcatgcaccaggccgagcccgccgagattaagtacgactacctgatcagcgccgtgggcgccgagcccaacacatttggaatccccggcgtgactgattacggtcacttcttcgaggagatccccaacagcctggaaatccggcggaccttcgccgccaacctagaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtcgaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcactgacctgttcaagaagatccctgagcagaacagcagcaagcggggcctggccgtgaatgacttcctgcaggtcaaaggcagcaacaacatcttcgccatcggcgacaacgcctttgccggcctgcctcctacagcccaggtggcccaccaggaagccgaatacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgcaaccatccgtagcggcaagcggaccttctacaccggcggaggcctgatgaccttctacttatggcggatcctgtacatgagcatgatcctgagcgcccgctcgagactgaaggtgtttttcgactggatcaagctggccttcttcaagagggacttcttcgagggcctgtga

SEQ ID NO: 521 - DNA, 1542 bp, Artificial Sequence
  source: /note="Description of Artificial Sequence: Synthetic polynucleotide"
atgctgagcaagaacctgtacagcaacaagcggttgctcaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatctctcccagaagctatttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctaggcatgcaccaggccgagcccgccgagattaagtacgactacctgatcagcgccgtgggcgccgagcccaacacctttggaattcccggcgtgaccgactacggccacttcttcgaggagatccccaactctctggaaatccggcggaccttcgccgccaacctggaagaggctaacctgctgcctaagggcgaccccgagcggagaaggctgctgagcatcgtggtggtgggcggaggccccactggcgtggaggctgctggcgagctgcaggactacgttcaccaggacctgcggaagttcctgcccgccttggccgaggaagtgcagattcacctggtggaagccctgcccatcgtgctgaacatgttcgagaagaagctgagcagctacgcccagagccacttagaaaacacctccatcaaagtgcacctgagaacggccgtggccaaggtggaagaaaagcagctgctggccaagaccaagcacgaggacggcaagattaccgaggaaaccatcccatacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaagaagccgaatacatcgccaagaacttcgacaagatggcccagatccccaatttccagaagaatctatcctcccggaaggataagatcgacctgctgttcgaggaaaacaacttcaagcccttcaagtacaacgatctgggcgccctggcatacctgggcagcgaaagagccattgccaccatccgttccggcaagcggaccttctacaccggcggaggcctgatgaccttctacctgtggcagatcctgtacatgagcatgatcctgagcgcccgctcgagactgaaggtgttcttcgactggatcaagctggcattcttcaagagggacttcttcgagggcctgtga

SEQ ID NO: 522 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttagcggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacctgagcatgatcctgagcgcccgcagcagactgaaggtgttcttcgactggatcaagatggccttcttcaagagggacttcttcaagggcctgtga

SEQ ID NO: 523 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcgaggagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagatggccttcttcaagagggacttcttcaagggcctgtga

SEQ ID NO: 524 - DNA, 1542 bp, Artificial Sequence
  source: /note="Description of Artificial Sequence: Synthetic polynucleotide"
atgctgagcaagaacctgtacagcaaccggcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 525 - DNA, 1542 bp, Artificial Sequence
  source: /note="Description of Artificial Sequence: Synthetic polynucleotide"
atgctgagcaagaacctgtacagcaaccggcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttagcggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacatgagcatgatcctgagcgcccgcagcagactgaaggtgttcttcgactggatcaagatggccttcttcaagagggacttcttcgagggcctgtga

SEQ ID NO: 526 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttagcggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacatgagcatgatcctgagcgcccgcagcagactgaaggtgttcttcgactggatcaagatggccttcttcaagagggacttcttcaagggcctgtga

SEQ ID NO: 527 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttagcggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcgagggcctgtga

SEQ ID NO: 528 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgcacacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcgaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 529 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcttcaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcgagggcctgtga

SEQ ID NO: 530 - DNA, 1542 bp, Artificial Sequence
  source: /note="Description of Artificial Sequence: Synthetic polynucleotide"
atgctgagcaagaacctgtacagcaaccggcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcttcgaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacctgagcatgatcctgagcgcccgcagcagactgaaggtgttcttcgactggatcaagctggccttcttcaagagggacttcttcgagggcctgtga

SEQ ID NO: 531 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcttcgaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcgagggcctgtga

SEQ ID NO: 532 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcttcgaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacctgagcatgatcctgagcgcccgcagcagactgaaggtgttcttcgactggatcaagatggccttcttcaagagggacttcttcgagggcctgtga

SEQ ID NO: 533 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 534 - DNA, 1542 bp, Artificial Sequence
  source: /note="Description of Artificial Sequence: Synthetic polynucleotide"
atgctgagcaagaacctgtacagcaacaagcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgcacacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcgaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttagcggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 535 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcatgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagatggccttcttcaagagggacttcttcgagggcctgtga

SEQ ID NO: 536 - DNA, 1542 bp, Artificial Sequence
  source: /note="Description of Artificial Sequence: Synthetic polynucleotide"
atgctgagcaagaacctgtacagcaaccggcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgcacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcgaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacatgagcatgatcctgagcgcccgcagcagactgaaggtgttcttcgactggatcaagctggccttcttcaagagggacttcttcaagggcctgtga

SEQ ID NO: 537 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgcacacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacatgagcatgatcctgagcgcccgcagcagactgaaggtgttcttcgactggatcaagctggccttcttcaagagggacttcttcaagggcctgtga

SEQ ID NO: 538 - DNA, 1542 bp, Artificial Sequence
  source: /note="Description of Artificial Sequence: Synthetic polynucleotide"
atgctgagcaagaacctgtacagcaaccggcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttagcggcctgcctcctacagcccaggtggcccaccaggaagccgagtacatcgccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 539 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgcacacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaagaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagatggccttcttcaagagggacttcttcgagggcctgtga

SEQ ID NO: 540 - DNA, 1542 bp, Artificial Sequence
  source: /note="Description of Artificial Sequence: Synthetic polynucleotide"
atgctgagcaagaacctgtacagcaaccggcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgatgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaaggagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcgagggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcagatcctgtacatgagcatgatcctgagcgcccgcagcagactgaaggtgttcttcgactggatcaagatggccttcttcaagagggacttcttcgagggcctgtga

SEQ ID NO: 541 - DNA, 1542 bp, Artificial Sequence
  source: /note="Description of Artificial Sequence: Synthetic polynucleotide"
atgctgagcaagaacctgtacagcaaccggcggctgctgaccagcaccaacaccatggtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaaagtacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagaacctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcttcaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcttccccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagatggccttcttcaagagggacttcttcgagggcctgtga

SEQ ID NO: 542 - protein, 513 aa, Saccharomyces cerevisiae
MLSKNLYSNKRLLTSTNTLVRFASTRSTGVENSGAGPTSFKTMKVIDPQHSDKPNVLILGSGWGAISFLKHIDTKKYNVSIISPRSYFLFTPLLPSAPVGTVDEKSIIEPIVNFALKKKGNVTYYEAEATSINPDRNTVTIKSLSAVSQLYQPENHLGLHQAEPAEIKYDYLISAVGAEPNTFGIPGVTDYGHFLKEIPNSLEIRRTFAANLEKANLLPKGDPERRRLLSIVVVGGGPTGVEAAGELQDYVHQDLRKFLPALAEEVQIHLVEALPIVLNMFEKKLSSYAQSHLENTSIKVHLRTAVAKVEEKQLLAKTKHEDGKITEETIPYGTLIWATGNKARPVITDLFKKIPEQNSSKRGLAVNDFLQVKGSNNIFAIGDNAFAGLPPTAQVAHQEAEYLAKNFDKMAQIPNFQKNLSSRKDKIDLLFEENNFKPFKYNDLGALAYLGSERAIATIRSGKRTFYTGGGLMTFYLWRILYLSMILSARSRLKVFFDWIKLAFFKRDFFKGL

SEQ ID NO: 543 - DNA, 24 bp, Artificial Sequence
  source: /note="Description of Artificial Sequence: Synthetic forward primer"
ttctcgaggtagggtgtcagtttc

SEQ ID NO: 544 - DNA, 29 bp, Artificial Sequence
  source: /note="Description of Artificial Sequence: Synthetic reverse primer"
aaagcggccgcagtgatcaaccaatcttg

SEQ ID NO: 545 - DNA, 20 bp, Artificial Sequence
  source: /note="Description of Artificial Sequence: Synthetic NDI1 forward primer"
caccagttgggacagtagac

SEQ ID NO: 546 - DNA, 20 bp, Artificial Sequence
  source: /note="Description of Artificial Sequence: Synthetic NDI1 reverse primer"
cctcatagtaggtaacgttc

SEQ ID NO: 547 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 548 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 549 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 550 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 551 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagaggaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 552 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 553 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctatggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 554 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttgtgcctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 555 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcatcaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 556 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccgtgatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 557 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagatgtaccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 558 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctaagagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 559 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctattccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 560 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgttcttgtccatgattctatctgcaagatcgagattaaaggtctttttcgactggattaaattagcatttttcaaaagagacttttttaaaggattatag

SEQ ID NO: 561 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctaaccgcaagatcgagattaaaggtctttttcgactggattaaattagcatttttcaaaagagacttttttaaaggattatag

SEQ ID NO: 562 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgttaccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 563 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctggaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 564 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 565 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 566 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 567 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 568 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 569 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 570 - DNA, 1542 bp, Artificial Sequence; identical to SEQ ID NO: 140
  source: /note="Description of Artificial Sequence: Synthetic polynucleotide"

SEQ ID NO: 571 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 572 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcatggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 573 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcgtgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 574 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcatcaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 575 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcgtgatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 576 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagatgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 577 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccaagagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 578 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgttccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 579 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgttcctgagcatgatcctgagcgcccgcagcagactgaaggtgttcttcgactggatcaagctggccttcttcaagagggacttcttcaagggcctgtga

SEQ ID NO: 580 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgaccgcccgcagcagactgaaggtgttcttcgactggatcaagctggccttcttcaagagggacttcttcaagggcctgtga

SEQ ID NO: 581 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcaccatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 582 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctggaggagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 583 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 584 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 585 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 586 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 587 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 588 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 589 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 590 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 591 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 592 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 593 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 594 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 595 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 596 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 597 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 598 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 599 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 600 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 601 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 602 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 603 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 604 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 605 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 606 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 607 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 608 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 609 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 610 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 611 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 612 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 613 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 614 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 615 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 616 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 617 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 618 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 619 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 620 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 621 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 622 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 623 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 624 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 625 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 626 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 627 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 628 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 629 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 630 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 631 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 632 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 633 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 634 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 635 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 636 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 637 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 638 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 639 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 640 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 641 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 642 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 643 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 644 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 645 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 646 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 647 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 648 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 649 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 650 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 651 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 652 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 653 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 654 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 655 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 656 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 657 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 658 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 659 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 660 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 661 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 662 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 663 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 664 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 665 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 666 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 667 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 668 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 669 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 670 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 671 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 672 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 673 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 674 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 675 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 676 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 677 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 678 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatag

SEQ ID NO: 679 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 680 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 681 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 682 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 683 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 684 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 685 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 686 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 687 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 688 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 689 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 690 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 691 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 692 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 693 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 694 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 695 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 696 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 697 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 698 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacatgtccatgattctatctgcaagatcgagattaaaggtctttttcgactggattaaattagcatttttcaaaagagacttttttaaaggattatag

SEQ ID NO: 699 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacttgtccatgattctatctgcaagatcgagattaaaggtctttttcgactggattaaattagcatttttcaaaagagacttttttaaaggattatag

SEQ ID NO: 700 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 701 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcttatacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 702 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 703 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcatctctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 704 - DNA, 1542 bp, Artificial Sequence
  source: /note="Description of Artificial Sequence: Synthetic polynucleotide"
atgctatcgaagaatttgtatagtaacaagaggttgctcacctcgacgaatacgctagtcagattcgcttccaccagatccacaggggtggaaaactccggagcaggtcctacatcttttaagaccatgaaaatcattgaccctcagcacagcgacaaaccaaacgtgctgatactgggttcggggtggggagctatttcgtttttaaagcacattgacaccaagaagtacaacgtttccatcgtgtctcctagaagctatttcatctacacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaaatccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattatctacatgtccatgattctatctgcaagatcgagattaaaggtctttttcgactggattaaattagcatttttcaaaagagacttttttaaaggattatag

SEQ ID NO: 705 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 706 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 707 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 708 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 709 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 710 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 711 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 712 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 713 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 714 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 715 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 716 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 717 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 718 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 719 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 720 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 721 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 722 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 723 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 724 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 725 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 726 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 727 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 728 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 729 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 730 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 731 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 732 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 733 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 734 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 735 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 736 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 737 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 738 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 739 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 740 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 741 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 742 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 743 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 744 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 745 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 746 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 747 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 748 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 749 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 750 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 751 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 752 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 753 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 754 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 755 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 756 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 757 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 758 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 759 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 760 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 761 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 762 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 763 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 764 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 765 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 766 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 767 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 768 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 769 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 770 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 771 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 772 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 773 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 774 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 775 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 776 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 777 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 778 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 779 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 780 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 781 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 782 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 783 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 784 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 785 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 786 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 787 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 788 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 789 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 790 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 791 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 792 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 793 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 794 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 795 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 796 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 797 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 798 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaagctggccttcttcaagagggacttcttcaagggcctgtga

SEQ ID NO: 799 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 800 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 801 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 802 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 803 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 804 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 805 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 806 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 807 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 808 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 809 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 810 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 811 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 812 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 813 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 814 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 815 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 816 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 817 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 818 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggccttcttcaagagggacttcttcaagggcctgtga

SEQ ID NO: 819 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 820 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 821 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 822 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 823 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 824 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 825 - DNA, 1542 bp, Artificial Sequence
  source: /note="Description of Artificial Sequence: Synthetic polynucleotide"
atgctatcgaagaatttgtatagcaacaagaggctgctcacctcgacgaacaccctagtgagattcgcttccaccagatccacaggggtggaaaacagcggggcaggtcctaccagcttcaagaccatgaaagtcattgaccctcagcacagcgacaagccaaacgtgctgatactgggttctgggtggggcgctatttcgtttttaaagcacatcgacaccaagaagtacaacgtttccatcatcagccctagaagctatttcctgttcacgcctttgttaccctctgccccagttgggacagtagacgagaagtccattattgagcccatcgttaattttgccctcaagaaaaaggggaacgtcacctactacgaggcagaagccacctctatcaatcccgacaggaataccgttaccataaagtcattatctgccgttagccagctataccaacctgaaaaccatctggggctgcatcaagccgaacctgccgagattaagtacgattacctgatcagtgctgtaggtgcggaacctaacacatttggaattcctggggtgactgattacggccatttcctgaaggagattcccaacagcttggaaataagacggacctttgccgccaatctagagaaggctaacctgttgccaaagggcgatcccgaaagaagaagactgctgtccattgtcgtcgttggtggagggcccacaggtgtagaggctgctggtgaactgcaggattacgtgcaccaggacctgcggaagttcctccctgcattggccgaagaagtccaaattcacctggtcgaagccctgcccatcgttttgaacatgtttgagaagaagctttcatcatacgcgcagagccatttagaaaacacttcgatcaaggtgcatctgagaacggctgtggccaaagttgaagaaaagcaattgctggcaaagacgaaacacgaagacggtaaaataaccgaagaaaccatcccatacggtactttgatttgggccaccggcaacaaggcaagaccggtgatcaccgaccttttcaagaaaattcctgagcagaactcgtccaagagaggactggcagtgaatgactttttgcaagtcaaaggcagcaacaacattttcgccattggtgacaacgcctttgccgggttgcctcctacagcccaggtggcgcaccaggaggccgaatacttggccaagaattttgacaagatggctcaaatccccaatttccaaaagaacctatcttcaagaaaggataagattgatctcttgttcgaggagaacaacttcaaacccttcaaatacaacgacttaggtgccctggcatacctgggatccgaaagggccattgccaccatacgttccggtaagagaacattctacaccggtggtggcttaatgaccttctacttatggcggattttgtacctgtccatgattctatctgcccgctcgagattaaaggtgtttttcgactggatcaagttagcatttttcaaaagagacttctttaaaggactgtag

SEQ ID NO: 826 - DNA, 1542 bp, Artificial Sequence
  source: /note="Description of Artificial Sequence: Synthetic polynucleotide"
atgctgtcgaagaacctgtacagtaacaagaggttgctgacctcgacgaatacgctagtcagattcgcttccaccagatccaccggcgtggaaaactccggagcaggtcctacatcttttaagaccatgaaagtcattgaccctcagcacagcgacaaaccaaacgtgctgatactgggttctgggtggggagccatttcgtttttaaagcacattgacaccaagaagtacaacgttagcatcatcagccctagaagctacttcttatttacgcccttgttacctagcgcaccagttggaaccgtagacgagaagtcaattatcgagcccatcgtgaacttcgccctgaagaaaaaggggaacgttacctactatgaggcagaagccacctctatcaatcccgacaggaacaccgtgaccataaaatcattatctgccgtgagccagctataccaacccgaaaaccacctggggctgcatcaagcagaacctgctgaaattaagtacgattatttaatcagcgccgtaggcgccgagcctaacacctttggtattcccggcgtcactgattacggtcatttcctgaaagagatccccaacagcctggaaataagacggacttttgccgccaacctggagaaggctaacttattgcctaagggcgaccccgagagaagaagactgctgtccattgtcgtcgtgggtggtggccccactggtgtagaagccgctggtgaactacaggattacgtgcaccaggacctgcggaagtttctgcctgcattggccgaggaagtccagattcacctggtcgaagctctgcccatcgttttgaacatgtttgagaagaagcttagctcatacgcgcaatcacacttagaaaacacctccatcaaagtacatctgagaacggctgtcgccaaggttgaagaaaagcagttgttggccaagacgaaacacgaagacggtaaaataaccgaagaaactattccatacggtactttgatttgggccacgggtaacaaggcaagaccggtaatcacagaccttttcaagaaaattcccgagcaaaacagctccaagcggggattggcagtgaatgactttttgcaagtcaaaggcagcaacaacattttcgccattggtgacaatgcatttgctgggttgccaccaaccgcccaggtggcgcaccaagaggccgagtatttggccaagaattttgacaagatggctcaaataccaaatttccagaagaacctgtcttcaagaaaggataaaattgatctgttgttcgaggaaaacaactttaaacctttcaaatacaacgatttaggcgccctggcctacctgggatccgaaagggccattgcaaccatccgttccggcaagagaaccttttacaccggcggtggcttaatgaccttctacctgtggagaattttgtacttgagcatgatcctatctgccagatcgagattaaaggtgttcttcgactggattaaattagcctttttcaaaagagacttttttaaaggactgtga

SEQ ID NO: 827 - DNA, 1542 bp, Artificial Sequence
  source: /note="Description of Artificial Sequence: Synthetic polynucleotide"
atgctatcgaagaacttgtatagtaacaagaggctgctcacctcgaccaacacgctcgtcagattcgctagcaccagatccacaggggtcgaaaacagcggagctggtcctacctcttttaagaccatgaaagtcattgacccccagcacagcgacaaaccaaacgtgctgatactgggttctgggtggggagctatttcgtttctgaagcacattgacaccaagaagtacaacgtctccatcatcagccccagaagctatttcttattcacccctctgctgccctctgcacctgtgggaacagtagacgagaagtcaattatcgagcccatcgtgaacttcgccctcaagaaaaaggggaacgttacctactatgaggcagaagccacctctatcaatcccgaccggaacaccgttaccatcaaatcattaagcgccgttagccagctataccaacctgaaaaccatctagggctgcaccaagcagaacctgctgagattaagtacgactacttaatcagtgccgtgggtgcggaacctaacacatttggtatccctggcgtcactgactacggtcacttcctgaaggaaattcccaactctttggaaatacggagaaccttcgccgccaacctagagaaggctaacttactgccaaagggtgatcccgagagaagaaggctactgtccattgtcgtggttggcggtgggcctactggtgtggaggctgctggtgagctacaggattatgttcaccaggacctgagaaagtttctccctgcactggccgaagaagtgcagattcacttggtcgaagctctgcccatcgttttgaatatgtttgagaaaaagcttagcagctacgcgcaatcacatttagaaaacacctcgatcaaagtacacctgagaacggctgtcgccaaagttgaagaaaagcagctgttggccaagacgaaacacgaagacggcaagataaccgaagaaactattccatacggtaccttgatttgggccacgggtaacaaggcaagacccgtgatcaccgaccttttcaagaaaattcctgagcaaaactcgtccaagcggggattggcagtgaacgactttctgcaagtgaaaggcagcaacaacattttcgccatcggcgacaatgcatttgccgggttgcctccaacagcccaggtggcgcaccaagaggccgaatatttggccaagaatttcgataagatggctcagataccaaatttccaaaagaacctatcttcaagaaaggataaaattgacctcttgttcgaggaaaacaactttaaacctttcaagtacaacgatttaggtgccttagcatacctgggctccgaaagggccattgcaaccatcagatccggtaagagaacattttacaccggtggtggcttaatgaccttctacctgtggagaattttgtacctgagcatgattctgtctgccagatcgagactgaaggtctttttcgactggattaaattagcatttttcaaaagggactttttcaagggattatga

SEQ ID NO: 828 - DNA, 1542 bp, Artificial Sequence
  source: /note="Description of Artificial Sequence: Synthetic polynucleotide"
atgctatcgaagaacttgtacagcaacaagaggttgctgacctcgaccaacacgctagtcagattcgctagcaccagatccaccggggtggaaaactccggagcaggtcccacatctttcaagaccatgaaagtcattgaccctcagcacagcgacaaaccaaacgtgctgatactgggttcgggctggggagctatttcgtttttaaagcacattgacaccaagaagtacaacgttagcatcatctctcctagaagctacttcctgtttacgcccctgctgccttctgcccctgtggggacagtggacgaaaagtccattattgagcccatcgtgaattttgctctcaagaaaaaggggaacgttacctactatgaggcagaagccaccagcatcaatcccgacaggaacaccgttaccataaaatcattatctgccgttagccagctataccaacctgagaaccatctagggctgcatcaagcagaacccgctgagattaagtacgattatttaatcagtgctgtgggtgcggagcctaacacctttggaatccctggggtcactgattacggtcacttcctgaaggagattcccaactctctggaaatcagaagaactttcgccgccaatctggaaaaggctaacttactgccaaagggtgatcccgagagaagaagactgctgtccattgtggtcgttggcggtgggcctactggcgtagaggccgctggcgagctacaggattatgtgcaccaggacctgagaaagttcctccctgccctggccgaggaagtccaaattcacttggtggaagccctgcccatcgtgttgaacatgtttgagaaaaagctgtcatcatacgcgcaatcacatctggaaaacacttccatcaaggtacacctgagaacggctgtcgccaaagttgaagagaagcaactgttggccaagacgaagcacgaagacggtaagattaccgaggaaactattccatacggtactctgatttgggccaccggtaacaaggccagacccgtaatcacagaccttttcaagaagattcctgagcaaaactcgtccaagagaggattggcagtgaatgactttctgcaagtgaaaggcagcaacaacattttcgccattggtgacaacgcctttgctgggttgccaccaaccgcccaggtggcgcaccaagaggccgaatatttggccaagaacttcgacaaaatggctcaaatcccaaatttccagaagaacctatcttcaagaaaggataaaatcgatctgttgttcgaggagaacaacttcaaacccttcaagtacaacgatttaggcgccttagcatacctgggatccgaaagggccattgcaaccataagatccggtaagagaaccttttacaccggtggtggcttaatgaccttctacttatggagaattttgtacttgtccatgattctgtctgcaagatcgagattaaaggtctttttcgactggattaagctggcctttttcaaaagggacttctttaaaggcttatag

SEQ ID NO: 829 - DNA, 1542 bp, Artificial Sequence
  source: /note="Description of Artificial Sequence: Synthetic polynucleotide"
atgctatcgaagaatttgtatagtaacaagaggttgctcaccagcacgaataccctagtccgcttcgcttccaccagatccacaggggtcgaaaactccggagcaggtcccacaagctttaagaccatgaaggtcattgaccctcagcacagcgacaaaccaaacgtgctgatcctgggttcggggtggggagctatctcgtttctgaagcacattgacaccaagaagtacaacgtctccatcatcagccccagaagctatttcttattcacgcccttgttaccttctgcccctgttgggacagtagacgaaaagtcaattattgagcccatcgttaattttgctctgaagaaaaaggggaacgttacctactatgaggcagaagccaccagcatcaatcccgacaggaacaccgttaccataaaaagcctgagcgccgttagccagctataccaacctgaaaaccacctagggctgcaccaagcagaacctgctgagattaagtacgattatttaatcagcgctgtgggcgccgagcctaacacatttggaattcctggcgtcactgactacggccatttcctgaaagagatccccaactctttggaaatcagaagaacttttgccgccaacctagagaaggccaacctgttgccaaagggcgatcccgaaagaagaagactgctgtccatcgtcgtggttggcggtgggcctactggtgtagaggccgctggtgaactacaggactacgtgcaccaggacctgcggaagtttctgcctgccttggccgaggaagtccaaattcacttggtcgaagctctgcccatcgttctgaacatgtttgagaaaaagctttcatcatacgcgcaatcacacttagaaaacacctcgatcaaggtacacctgagaacggccgtcgccaaagttgaagagaagcagttgctggcaaagaccaaacacgaagacggcaaaataaccgaagaaactattccatacggtactttgatttgggccacgggtaacaaggcaagacccgtaatcacagaccttttcaagaaaattcccgagcagaactcgtccaagagaggactggcagtgaatgactttctgcaggtgaaaggcagcaacaacatcttcgccattggcgacaacgcatttgctgggctgccaccaaccgcccaggtggcccaccaagaggccgaatacttggccaagaatttcgataagatggctcagataccaaatttccaaaagaatctatcttcaagaaaggataaaattgatctcctgttcgaggagaacaacttcaaacccttcaaatacaacgatttaggtgccttagcatacctgggatccgaaagagccattgcaaccatacgttccggcaagagaaccttttacaccggtggaggcctgatgaccttctacttatggagaatcttgtacttgtccatgattctgtctgcaagatcgagattaaaggtgttcttcgactggatcaagctggcctttttcaaaagagacttcttcaagggattatag

SEQ ID NO: 830 - DNA, 1542 bp, Artificial Sequence
  source: /note="Description of Artificial Sequence: Synthetic polynucleotide"
atgctatcgaagaacttgtacagtaacaagaggttgctgacctcgaccaatacgctagtccgcttcgcttccaccagatccacaggcgtcgaaaactccggagctggtcctacctctttcaagaccatgaaagtcattgaccctcagcacagcgacaaaccaaacgtgctgatactgggttcggggtggggcgctatttcgtttctgaagcacattgacaccaagaagtacaacgtttccatcatctctcctagaagctatttcttattcacgcctctgttaccttctgccccagttgggacagtagacgaaaagtccatcattgagcccatcgttaatttcgctctcaagaaaaaggggaacgttacctactacgaggcagaagccacctctatcaatcccgacaggaacaccgttaccataaaatcattatctgccgtgagccagctgtaccaacctgaaaaccatctaggcctgcaccaggccgagcccgctgaaattaagtacgattatctgatcagtgctgtgggcgcggaacctaacacctttggaattcctggcgtcactgattacggccatttcctgaaggaaatccccaactctttggaaatccggagaacttttgccgccaatctagagaaggccaacctgttgccaaagggcgatcccgaacggagaaggctactgtccattgtggtcgtgggcggtgggcctactggtgtggaggccgctggtgaactgcaggattatgttcaccaggacctgcggaagttcctccctgcattggccgaagaagtccagattcacttggtggaagctctgcccatcgttttgaacatgtttgagaagaagcttagctcatacgcccaatcacacttagaaaacacttcgatcaaagtgcatctgagaacggctgtcgccaaggttgaagaaaagcaattgttggccaagaccaagcacgaagacggtaaaataaccgaggaaactattccatacggtactttgatttgggccacgggtaacaaggcaagacccgtaatcacagacctgttcaagaagatccctgagcaaaactcgtccaagagaggcctggcagtgaatgactttctgcaggtgaaaggcagcaacaacattttcgccatcggtgacaacgcatttgccgggttgccaccaaccgcccaggtggcgcaccaagaagccgaatacctggccaagaatttcgataagatggcccaaatcccaaatttccaaaagaatctatcttcaagaaaggataagattgatctcttgttcgaggagaacaactttaaacctttcaagtacaacgatttaggcgccttagcatacctgggatccgaaagggccattgcaaccataagaagcggtaagcggacattttacaccggcggaggcttaatgaccttctacttatggagaatcttgtacctgagcatgattctgtctgcacgctcgagattaaaggtgtttttcgactggattaaattagcatttttcaagagagacttcttcaaaggattatag

SEQ ID NO: 831 - DNA, 1542 bp, Artificial Sequence
  source: /note="Description of Artificial Sequence: Synthetic polynucleotide"
atgctaagcaagaacctgtacagtaacaagaggctgctgacctcgacgaatacgctagtcagattcgcttccaccagatccaccggcgtggaaaacagcggagcaggtcccacctctttcaagaccatgaaagtcattgaccctcagcacagcgacaaaccaaacgtgctgatactgggttcggggtggggagctatttcgtttttaaagcacattgacaccaagaagtacaacgtctccatcatcagccccagaagctatttcttatttacgcccctgttacctagcgcccctgttgggacagtggacgaaaagtcaattattgagcccatcgttaattttgctctcaagaaaaagggcaacgttacctactatgaggcagaagccacctctatcaaccccgacaggaataccgttaccataaaatcattaagcgccgtttcccagctgtaccaacctgaaaaccatctaggcctgcatcaagccgaacctgccgaaattaagtacgattatctgatcagtgctgtgggtgcggagcccaacacatttggtattcctggggtcactgactacggtcatttcctgaaggaaattcccaactctttggaaataagaagaacttttgccgccaatctggaaaaggccaacctgttgcctaagggcgatcccgagagaagaagactgctgtccattgtcgtcgtgggtggtgggcccactggtgtagaggctgctggtgaactacaggattacgttcaccaggacctgcggaagtttctgcctgccctggccgaagaagtccagattcacctggtggaagctctgcccatcgttctgaacatgtttgagaaaaagctttcatcatacgcccaatcacacttagaaaacacttccatcaaagtgcatctgagaacggctgtggccaaggtggaagaaaagcaactgttggcaaagaccaagcacgaggacggtaaaattaccgaagaaactattccatacggtactttgatttgggccacgggtaacaaggccagacccgtaatcacagaccttttcaagaaaattcctgagcaaaactcgtccaagagaggactggccgtgaatgacttcctgcaagtgaaaggcagcaacaacatcttcgccattggtgacaacgcctttgctgggctgccacctaccgcccaagtggcccaccaagaggccgagtatttggccaagaactttgataaaatggcccagataccaaatttccagaagaatctatcctcaagaaaggataaaattgatctcttgttcgaggagaacaactttaaacctttcaaatacaacgatttaggtgccttagcatacctgggcagcgaaagggccattgcaaccatccgttccggcaagagaacattttacaccggcggtggcctgatgaccttctacttatggagaattttgtacctgtccatgattctgtctgcaagaagcagactgaaggtgtttttcgactggatcaaattagcattcttcaaaagggacttttttaaaggattatag

SEQ ID NO: 832 - DNA, 1542 bp, Artificial Sequence
  source: /note="Description of Artificial Sequence: Synthetic polynucleotide"
atgctgtcgaagaatttgtatagcaacaagaggttgctcaccagcacgaatacgctcgtcagattcgcttccaccagatccaccggggtcgaaaacagcggagcaggccctacatcttttaagaccatgaaagtcatcgaccctcagcacagcgacaagccaaacgtgctgatactgggttcggggtggggagctatttcgtttttaaagcacattgacaccaagaagtacaacgtctccatcatctctcccagaagctatttcttatttacgcccttgttaccttctgcaccagttgggacagtagacgaaaagtcaattatcgagcccatcgtgaattttgctctcaagaaaaaggggaacgtcacctactatgaggcagaggccaccagcatcaaccccgacaggaataccgttaccataaaaagcttaagcgccgtgagccagctataccagcctgaaaaccatctagggctgcatcaagcagaacccgccgaaattaagtacgattacctgatcagcgctgtaggtgcggaacctaacacatttggtattcctggcgtcactgattacggccatttcctgaaggaaatccccaactctctggaaataagaagaactttcgccgccaatctggagaaggctaacttattgccaaagggtgatcccgaacggagaagactactgtccattgtcgtggttggcggtgggcccactggtgtagaagccgctggcgaactacaggattatgtgcaccaggacctgagaaagtttctccctgcattggccgaagaagtccaaattcacttggtcgaagctctgcccatcgtgctgaacatgtttgagaagaagcttagcagctacgcgcaatcacatttagaaaacacctcgatcaaagtacatctgagaaccgctgtcgccaaggtggaagaaaagcaactgttggcaaagacgaagcacgaggacggtaaaataaccgaggaaactatcccatacggtactttgatttgggccacgggtaacaaggccagaccggtaatcacagacctgttcaagaaaattcctgagcaaaacagctccaagcggggattggcagtgaacgactttctgcaagtgaaaggcagcaacaacattttcgccatcggcgacaacgcctttgccgggctgccacctaccgcccaagtggcccaccaggaggccgagtatttggccaagaattttgataaaatggcccaaatccccaatttccagaagaatctgtcttcaagaaaggataagattgatctgttgttcgaggagaacaactttaagcctttcaagtacaacgacttaggtgccttagcctacctgggatccgaaagagccattgccaccatacgttccggtaagcggaccttctacaccggtggtggcctgatgaccttctacttatggcggattctgtacttgagcatgattctgagcgcccgctcgagactgaaggtgtttttcgactggattaaattagcatttttcaagagggacttctttaaaggattatag

SEQ ID NO: 833 - DNA, 1542 bp, Artificial Sequence
  source: /note="Description of Artificial Sequence: Synthetic polynucleotide"
atgctgagcaagaacttgtatagtaacaagaggctgctcacctcgacgaataccctagtcagattcgctagcaccagatccaccggggtggaaaactccggagcaggtcccacctcttttaagaccatgaaagtcattgacccccagcacagcgacaagcccaacgtgctgatactgggctcggggtggggagctatctcgtttctgaagcacatcgacaccaagaagtacaacgtctccatcatctctcctagaagctatttcttatttacgcctctgttacctagcgcaccagttgggacagtggacgaaaagtcaatcatcgagcccatcgttaattttgctctgaagaaaaaggggaacgtcacctactatgaggcagaggccacctctatcaatcccgacaggaataccgttaccataaaatcattatctgccgttagccagctataccagcctgagaaccatctggggctgcatcaagccgagcctgctgaaattaagtacgattacttaatcagtgctgtaggcgccgagcccaacacatttggtattcctggggtgactgattacggtcatttcctgaaggagattcccaactctttggaaataagaagaaccttcgccgccaatctagaaaaggccaacttactgccaaagggtgatcccgagagaagaaggctactgtccattgtcgtcgttggtggtgggcccacaggtgtagaagctgctggtgaactacaggattatgttcaccaggacctgagaaagtttctgcctgcattggccgaagaagtccagattcacctggtcgaagccctgcccatcgtgttgaatatgttcgagaaaaagctttcaagctacgcgcaatcacatttagaaaacacctccatcaaggtgcatctgagaacggctgtcgccaaagttgaagagaagcaattgctggcaaagacgaaacacgaagacggtaaaataaccgaagaaactatcccatacggtactttgatttgggccaccggtaacaaggcaagaccggtaatcacagaccttttcaagaaaattcctgagcaaaactcgagcaagagaggattggcagtgaatgactttttgcaggtcaaaggcagcaacaacattttcgccatcggtgacaatgcctttgctggcttgccaccaacagcccaggtggcccaccaagaagccgaatatttggccaagaatttcgataaaatggctcagatacccaatttccaaaagaatctatcttcccggaaggataaaatcgatctcctgttcgaggagaacaacttcaaacctttcaaatacaacgacctgggtgccctggcatacctgggaagcgaaagggccattgcaaccatccgttccggtaagcggaccttctacaccggcggaggcttaatgaccttctacttatggagaattttgtacttgagcatgattctatctgcacgctcgagactgaaggtctttttcgactggattaaattagcctttttcaagagagacttcttcaaaggattatga

SEQ ID NO: 834 - DNA, 1542 bp, Artificial Sequence
  source: /note="Description of Artificial Sequence: Synthetic polynucleotide"
atgctgagcaagaatttgtacagtaacaagaggttgctcacctcgacgaacacgctagtcagattcgcctccaccagatccaccggcgtcgaaaactccggggcaggccctacatcttttaagaccatgaaggtcatcgaccctcagcacagcgacaaacccaacgtgctgatcctgggttcggggtggggagctatctcgtttctgaagcacattgacaccaagaagtacaacgtttccatcatctctcccagaagctatttcttattcacccccctgctgccttctgcaccagttgggacagtagacgaaaagtcaattattgagcccatcgttaatttcgctctcaagaaaaagggcaacgttacctactatgaggccgaggccacctctatcaatcccgacaggaataccgttaccataaaaagcttatctgccgtttcccagctgtaccaacccgaaaaccacctagggctgcatcaagccgaacctgctgaaattaagtacgattatctgatcagtgccgtaggcgccgagcctaacacatttggaattcctggggtcactgattacggtcacttcctgaaggaaattcccaactctttggaaataagaagaaccttcgccgccaatctagagaaggctaacttactgccaaagggcgatcccgagagaagaagactactgtccatcgtcgtggttggcggtgggcctactggtgtagaggccgctggcgagctacaggactatgttcaccaggacctgcggaagtttctccccgccctggccgaagaagtccagattcacttggtcgaagctctgcccatcgtgttgaatatgtttgagaaaaagcttagctcatacgcgcagagccacttagaaaacacttccatcaaggtacatctgagaacggccgtcgccaaagttgaagaaaagcagctgttggcaaagacgaaacacgaagacggtaaaataaccgaagaaaccatcccctacggtactttgatttgggccacgggtaacaaggcaagaccggtaatcacagaccttttcaagaaaattcctgagcaaaactcgtccaagcggggactggcagtgaacgactttctgcaggtgaaaggcagcaacaacattttcgccattggtgacaacgcatttgctgggttgccaccaaccgcccaggtggcgcaccaagaggccgagtatttggccaagaatttcgataagatggcccaaataccaaatttccagaagaacctgtcttcaagaaaggataaaattgatctgttgttcgaggagaacaacttcaagcctttcaaatacaacgatctgggtgccttagcatacctgggctccgaaagggccattgccaccatcagaagcggcaagcggaccttctacaccggtggaggcttaatgaccttctacttatggagaattttgtacctgtccatgattctaagcgcaagatcgagactgaaggtgtttttcgactggattaaactggcatttttcaaaagagacttttttaaaggattatag

SEQ ID NO: 835 - DNA, 1542 bp, Artificial Sequence
  source: /note="Description of Artificial Sequence: Synthetic polynucleotide"
atgctaagcaagaatttgtatagcaacaagcggctgctcacctcgacgaatacgctcgtcagattcgcctccaccagatccacaggcgtcgaaaactccggagctggccctacatcttttaagaccatgaaagtcattgaccctcagcacagcgacaaacccaacgtgctgatactgggttctgggtggggagctatcagctttctgaagcacattgacaccaagaagtacaacgtctccatcatctctcctagaagctatttcttatacacccctttgttacccagcgcaccagttggaaccgtagacgagaagtcaattatcgagcccatcgtgaattttgccctgaagaaaaaggggaacgttacctactacgaggccgaagccacctctatcaaccccgacaggaataccgttaccatcaaaagcttaagcgccgttagccagctataccaacctgagaaccatctagggctgcatcaagcagaacccgctgaaattaagtacgattatttaatcagcgctgtaggtgcggagcctaacacctttggaattcccggcgtcactgattacggtcacttcctgaaggaaattcccaactctttggaaatcagaagaacttttgccgccaatctagaaaaggctaacttactgccaaagggtgatcccgagagaagaagactactgtccattgtcgtcgttggcggagggcccacaggtgtggaagccgctggcgaactacaggattatgttcaccaggacctgagaaagtttctgcccgccctggccgaggaagtccaaattcacttggtcgaagctctgcccatcgttttgaatatgtttgagaaaaagctgtcatcatacgcgcagagccatctggaaaacacttcgatcaaagtacatctgagaaccgctgtcgccaaggttgaagaaaagcaactgctggcaaagacgaaacacgaagacggtaaaataaccgaagaaaccattccatacggtaccctgatttgggccacgggtaacaaggcaagaccggtaatcacagaccttttcaagaaaattcctgagcaaaactcgtccaagcggggcctggcagtgaacgactttttgcaagtgaaaggcagcaacaacattttcgccattggcgacaatgcatttgctgggttgccaccaaccgcccaggtggcgcaccaagaggccgagtatttggccaagaattttgataagatggcccaaatacccaatttccagaagaacctatcttcaagaaaggataaaattgatctcttgttcgaggaaaacaactttaagcccttcaaatacaacgatttaggtgccttagcatacctgggctccgaaagggccattgcaaccatcagatccggtaagcggaccttttacaccggtggaggcttaatgaccttctacttatggagaatcctgtacctgtccatgattctatctgccagatcgagactgaaggtctttttcgactggattaaattagcctttttcaaaagagacttctttaagggattatga

SEQ ID NO: 836 - DNA, 1542 bp, Artificial Sequence
  source: /note="Description of Artificial Sequence: Synthetic polynucleotide"
atgctatcgaagaatttgtatagtaacaagaggctgctcaccagcaccaatacgctagtgagattcgcttccaccagatccacaggggtggaaaactccggagcaggtcccacctcttttaagaccatgaaagtcattgaccctcagcacagcgacaagcccaacgtgctgatcctgggttcgggctggggcgctattagctttttaaagcacatcgacaccaagaagtacaacgtttccatcgtgagccctagaagctatttcctgtttacgcccttgttaccttctgccccagttgggacagtagacgaaaagtcaattattgagcccatcgttaattttgctctgaagaaaaagggcaacgttacctactatgaggcagaggccaccagcatcaatcccgacaggaataccgtgaccataaagtcattatctgccgtttcccagctataccaacctgaaaaccacctaggcctgcatcaagcagaacctgctgagattaagtacgactatttaatcagtgccgtaggcgcggaacctaacacatttggtatccctggggtgaccgattacggtcacttcctgaaggaaatccccaactctttggaaatacggagaactttcgccgccaacctggagaaggctaacttattgccaaagggtgaccccgaaagaagaaggctgctgtccatcgtcgtggtgggtggtggccctacaggtgtggaggctgctggtgaactgcaggattatgttcaccaggacctgcggaagtttctccctgcattggccgaagaagtccaaattcacttggtcgaagccctgcccatcgttttgaatatgttcgagaaaaagctttcatcatacgcgcaatcacatctggaaaacacttcgatcaaagtacatctgagaacggctgtggccaaggttgaagaaaagcaattgttggccaagacgaaacacgaggacggtaagataaccgaggaaactatcccctacggtaccttgatttgggccacgggtaacaaggcaagacccgtaatcacagaccttttcaagaaaattcctgagcagaacagctccaagagaggcctggccgtgaatgactttctgcaagtgaaaggcagcaacaacattttcgccattggcgacaatgcatttgctgggctgccaccaacagcccaggtggcccaccaagaggccgaatatttggccaagaattttgataaaatggctcaaataccaaatttccaaaagaatctgtcctcacggaaggataaaattgatctcctgttcgaggagaacaacttcaaacctttcaaatacaacgatttaggtgccctggcctacctgggcagcgaaagagccattgcaaccatacgtagcggcaagagaacattctacaccggcggtggcctgatgaccttctacttatggcggattttgtacttgtccatgattctgtctgcccgctcgagattaaaggtctttttcgactggattaaactggccttcttcaaaagagacttctttaaaggcctgtga

SEQ ID NO: 837 - DNA, 1542 bp, Artificial Sequence
  source: /note="Description of Artificial Sequence: Synthetic polynucleotide"
atgctatcgaagaacctgtatagtaacaagaggctgctcaccagcacgaatacgctagtcagattcgcttccaccagatccaccggcgtcgaaaacagcggagcaggtcccaccagctttaagaccatgaaaatcatcgaccctcagcacagcgacaaaccaaacgtgctgatcctgggctcggggtggggagctatctcgtttttaaagcacatcgacaccaagaagtacaacgttagcatcatctctcctagaagctatttcttattcacgcctttgttaccctctgcaccagttgggaccgtagacgaaaagtccattattgagcccatcgtgaattttgctctcaagaaaaagggcaacgtcacctactacgaggcagaggccacctctatcaatcccgacaggaataccgttaccatcaaaagcttatctgccgttagccagctataccagcctgaaaaccacctagggctgcatcaagcagagcctgccgaaattaagtacgattatttaatcagtgccgtgggtgcggaacctaacacatttggtattcctggggtgactgattacggtcatttcctgaaagaaattcccaacagcctggaaatcagaagaacttttgccgccaatctggaaaaggctaacttattgccaaagggcgatcccgaaagaagaaggctactgagcattgtcgtggttggtggagggcctacaggtgtagaggccgctggcgaactgcaggattatgttcaccaggacctgagaaagtttctccctgcactggccgaggaagtccagattcacctggtcgaagctctgcccatcgttctgaatatgttcgagaaaaagctttcatcatacgcgcaaagccatttagaaaacacttccatcaaggtgcacctgagaaccgctgtcgccaaggttgaagagaagcaattgttggcaaagaccaaacacgaagacggtaagataaccgaagaaactattccatacggtactttgatttgggccacgggtaacaaggcaagaccggtgatcacagacctgttcaagaaaattcctgagcagaacagctccaagagaggattggccgtgaatgactttttgcaagtcaaaggcagcaacaacattttcgccattggcgacaatgcctttgccgggttgccacctaccgcccaggtggcgcaccaagaagccgaatatttggccaagaatttcgacaaaatggcccagatccccaatttccaaaagaatctatcttcaagaaaggataaaattgacctcctgttcgaggagaacaacttcaagcctttcaaatacaacgacttaggtgccctggcatacctgggcagcgaaagagccattgccaccatacgttccggcaagagaacattctacaccggtggtggcctgatgaccttctacttatggagaattctgtacttgtccatgatcctatctgcaagatcgagattaaaggtctttttcgactggattaaattagcctttttcaaaagagacttttttaaaggcttatga

SEQ ID NO: 838 - DNA, 1542 bp, Artificial Sequence
  source: /note="Description of Artificial Sequence: Synthetic polynucleotide"
atgctatcgaagaacttgtatagtaacaagcggttgctcacctcgaccaatacgctcgtcagattcgcttccaccagatccacaggggtggaaaactccggagctggtcctacatctttcaagaccatgaaagtcatcgaccctcagcacagcgacaagccaaacgtgctgatactgggctcgggctggggagctatctcgtttttaaagcacattgacaccaagaagtacaacgtctccatcatctctcctagaagctatttcttatttacccccttgttaccttctgccccagttggaaccgtagacgaaaagtcaattattgagcccatcgttaacttcgccctcaagaaaaagggcaacgttacctactacgaggcagaagccacctctatcaaccccgacaggaacaccgttaccataaaatcattatctgccgttagccagctataccaacctgagaaccatctagggctgcatcaagcagagcccgctgaaattaagtacgattacctgatcagcgccgtaggtgccgaacccaacacatttggtattcctggcgtgactgattacggtcatttcctgaaagagattcccaacagcttggaaataagacggacttttgccgccaatctagaaaaggctaacctgttgccaaagggtgaccccgaaagaagaagactactgtccattgtcgtggttggcggtgggcctacaggcgtggaggccgctggtgaactgcaggattacgtgcaccaggacctgcggaagtttctgcctgccttggccgaagaagtccaaattcacttggtcgaagctctgcccatcgttttgaacatgtttgagaaaaagctttcatcatacgcgcaatcacatttagaaaacacttcgatcaaggtacatctgagaacggccgtcgccaaagtggaagaaaagcaattgttggcaaagacgaaacacgaagacggtaagattaccgaggaaactattccatacggtactctgatttgggccacgggtaacaaggccagacccgtgatcacagaccttttcaagaaaattcctgagcagaacagcagcaagcggggcctggcagtgaatgactttctgcaggtgaaaggcagcaacaacattttcgccattggtgacaacgcctttgctggcttgccaccaaccgcccaggtggcgcaccaagaggccgaatatctggccaagaacttcgacaaaatggctcaaatcccaaatttccaaaagaatctatcctccagaaaggataaaattgatctcctgttcgaggagaacaactttaaacctttcaagtacaacgatctgggtgccttagcatacctgggaagcgaaagagccattgcaaccatccgttccggtaagagaacattttacaccggcggtggcctgatgaccttctacctgtggagaattatctacttgtccatgatcctatctgcaagaagcagactgaaggtgtttttcgactggattaaactggcatttttcaaaagagacttctttaagggcctgtag

SEQ ID NO: 839 - DNA, 1542 bp, Artificial Sequence
  source: /note="Description of Artificial Sequence: Synthetic polynucleotide"
atgctgtcgaagaatctgtatagtaacaagaggttgctcaccagcacgaatacgctcgtccgcttcgcttccaccagatccacaggggtcgaaaactccggagctggccctacaagctttaagaccatgaaagtcattgaccctcagcacagcgacaaaccaaacgtgctgatactgggttcgggctggggagctatttcgtttctgaagcacattgacaccaagaagtacaacgttagcatcatctctcccagaagctatttcatcttcacccctttgttaccttctgcacctgttgggacagtagacgaaaagtcaattattgagcccatcgttaattttgctctgaagaaaaaggggaacgttacctactatgaggccgaagccacctctatcaatcccgacaggaacaccgttaccataaaatcactgagcgccgtttcccagctgtaccagcctgaaaaccatctggggctgcatcaggccgaacccgctgaaattaagtacgattatttaatcagcgccgtaggcgccgaacccaacacatttggtattcctggcgtcaccgattacggtcatttcctgaaggagattcccaacagcctggaaataagaagaacttttgccgccaacctagaaaaggccaacttattgccaaagggcgaccccgaaagaagaaggctactgtccattgtcgtggtgggtggagggcccactggtgtggaagccgctggcgagctgcaggattacgttcaccaggacctgcggaagtttctgcctgcattggccgaagaagtccagattcacttggtggaagccctgcccatcgttttgaatatgtttgagaaaaagctgtcaagctacgcgcaatcacatttagaaaacacttcgatcaaagtacatctgagaacggctgtggccaaagtggaagaaaagcaattgttggccaagacgaaacacgaagacggtaagataaccgaggaaactattccatacggcactttgatttgggccaccggtaacaaggccagaccggtaatcacagaccttttcaagaagattcccgagcagaactcgtccaagcggggcttggcagtgaatgactttctgcaagtgaaaggcagcaacaacattttcgccattggtgacaatgcatttgctgggttgccaccaaccgcccaggtggcgcaccaagaggccgagtacctggccaagaattttgataagatggctcagatcccaaatttccagaagaatctgtcttcccggaaggataagattgatctcttgttcgaggaaaacaactttaagcctttcaaatacaacgacttaggcgccttagcatacctgggaagcgaaagggccattgcaaccatacgttccggtaagagaacattttacaccggtggaggcttaatgaccttctacttatggagaattttgtacctgagcatgatcctatctgcacgcagcagactgaaggtctttttcgactggattaaattagcatttttcaaaagagactttttcaagggattatag

SEQ ID NO: 840 - DNA, 1542 bp, Artificial Sequence
  source: /note="Description of Artificial Sequence: Synthetic polynucleotide"
atgctatcgaagaatctgtatagcaacaagaggttgctcacctcgaccaatacgctagtccgcttcgcttccaccagatccacaggcgtggaaaactccggggctggtcctacatcttttaagaccatgaaagtcattgacccccagcacagcgacaaacccaacgtgctgatactgggttctggctggggagctattagctttttaaagcacattgacaccaagaagtacaacgtttccatcatctctcctagaagctatttcttatacacgcctttgttaccctctgcacctgtggggacagtagacgagaagtcaattattgagcccatcgttaattttgctctgaagaaaaaggggaacgttacctactacgaggcagaagccacctctatcaatcccgaccggaacaccgttaccataaagtcactgtctgccgtttcccagctataccaacctgaaaaccacctaggcctgcaccaagcagaacctgctgaaattaagtacgactacctgatcagtgctgtaggtgcggaacctaacacatttggaattcctggcgtcactgattacggtcatttcctgaaggaaatccccaactctctggaaataagaagaaccttcgccgccaacctagagaaggccaacttactgccaaagggtgatcccgaacggagaaggctactgtccattgtcgtcgtgggcggaggccctactggtgtagaggctgctggtgaactgcaggactacgtgcaccaggacctgagaaagttcctccctgccttggccgaagaagtccaaattcacctggtcgaagctctgcccatcgtgttgaatatgttcgagaaaaagctttcatcatacgcgcagagccatttagaaaacacttcgatcaaagtgcatctgagaaccgctgtcgccaaagttgaagagaagcagttgctggcaaagaccaagcacgaagacggtaaaataaccgaggaaaccattccatacggcactttgatttgggccaccggtaacaaggcaagacccgtaatcacagaccttttcaagaagattcctgagcagaactcgtccaagagaggattggccgtgaacgactttttgcaggtcaaaggcagcaacaacatcttcgccatcggcgacaatgcatttgctgggttgccaccaaccgcccaagtggcgcaccaagaggccgagtacttggccaagaattttgataaaatggctcaaataccaaatttccagaagaatctatcttcaagaaaggataaaatcgatctcttgttcgaggagaacaactttaaacccttcaaatacaacgatctgggcgccttagcatacctgggatccgaaagagccattgccaccatccgtagcggcaagagaacattctacaccggtggaggcttaatgaccttctacctgtggagaattctgtacttgtccatgatcctatctgcaagatcgagattaaaggtcttcttcgactggattaaattagcctttttcaagagagacttttttaaaggcttatga

SEQ ID NO: 841 - DNA, 1542 bp, Artificial Sequence
  source: /note="Description of Artificial Sequence: Synthetic polynucleotide"
atgctatcgaagaatctgtatagtaacaagaggttgctcacctcgaccaatacgctagtgagattcgcttccaccagatccacaggggtggaaaacagcggagcaggtcccacatcttttaagaccatgaaaatcattgaccctcagcacagcgacaaacccaacgtgctgatactgggttctgggtggggcgctatttcgtttttaaagcacattgacaccaagaagtacaacgttagcatcatcagccccagaagctacttcttattcacgcccttgttacctagcgcaccagttgggaccgtagacgagaagtccattattgagcccatcgtgaatttcgctctcaagaaaaaggggaacgttacctactatgaggcagaggccacctctatcaaccccgaccggaataccgttaccataaagagcttatctgccgtgtcccagctataccaacctgagaaccatctagggctgcaccaagcagaacccgctgaaattaagtacgattatttaatcagtgctgtaggtgcggagcccaacacatttggtatccctggggtcaccgactacggtcatttcctgaaggaaatccccaacagcttggaaataagaagaacttttgccgccaacctagagaaggccaacctgttgccaaagggtgatcccgaaagaagaagactactgtccattgtcgtcgtgggtggaggccctactggtgtggaggctgctggcgaactgcaggactatgtgcaccaggacctgagaaagttcctccctgcactggccgaagaagtccaaattcacttggtcgaagctctgcccatcgttttgaatatgttcgagaaaaagcttagcagctacgcgcaatcacatttagaaaacacctcgatcaaagtgcatctgagaacggctgtcgccaaagttgaagagaagcagttgttggcaaagaccaaacacgaggacggtaaaataaccgaagaaactatcccctacggtactctgatttgggccacgggtaacaaggccagaccggtaatcaccgacctgttcaagaagattcctgagcagaactcgtccaagcggggactggcagtgaacgacttcttgcaagtgaaaggcagcaacaacattttcgccattggtgacaatgcatttgccgggctgccaccaaccgcccaagtggcccaccaggaggccgagtatttggccaagaattttgataaaatggcccaaataccaaatttccagaagaatctatcttcacggaaggataagattgatctcctgttcgaggagaacaacttcaaacctttcaaatacaacgatttaggtgccttagcatacctgggcagcgaaagggccattgcaaccatacgtagcggtaagcggacattctacaccggcggtggcttaatgaccttctacttatggagaatcctgtacttgtccatgatcctatctgcacgctcgagattaaaggtcttcttcgactggatcaaattagcatttttcaagagggacttcttcaaaggattatag

SEQ ID NO: 842 - DNA, 1542 bp, Artificial Sequence
  source: /note="Description of Artificial Sequence: Synthetic polynucleotide"
atgctatcgaagaatttgtatagcaacaagaggttgctcaccagcacgaataccctcgtcagattcgccagcaccagatccaccggcgtcgaaaactccggagcaggtcctacatcttttaagaccatgaaagtcattgacccccagcacagcgacaagccaaacgtgctgatcctgggttcggggtggggagctatttcgtttttaaagcacatcgacaccaagaagtacaacgtttccatcgtgtctcctagaagctatttcctgtttacgcctttgttaccctctgccccagttgggaccgtagacgaaaagtccattattgagcccatcgttaacttcgccctgaagaaaaagggcaacgttacctactatgaggcagaagccacctctatcaatcccgacaggaataccgttaccataaagtcattaagcgccgttagccagctataccagcccgaaaaccacctagggctgcaccaagcagaacctgctgaaattaagtacgactacttaatcagtgccgtgggtgcggaacctaacacctttggaattcctggggtgactgattacggtcatttcctgaaagaaatccccaacagcttggaaatccggcggacttttgccgccaacctagagaaggccaacttactgccaaagggtgatcccgagagaagaagactactgtccattgtcgtggttggtggagggcccactggcgtagaggccgctggtgaactacaggattatgtgcaccaggacctgcggaagtttctccctgcactggccgaagaagtccaaattcacctggtcgaagctctgcccatcgtgttgaatatgtttgagaaaaagctttcatcatacgcccaaagccacctggaaaacacctcgatcaaagtacatctgagaacggctgtggccaaggttgaagagaagcaattgctggccaagacgaagcacgaagacggtaaaattaccgaagaaaccattccatacggtactctgatttgggccacgggcaacaaggcaagaccggtgatcacagaccttttcaagaaaatccctgagcaaaactcgtccaagagaggattggcagtgaatgactttttgcaagtgaaaggcagcaacaacatcttcgccattggtgacaatgcctttgccgggttgcctccaacagcccaggtggcccaccaagaggccgagtatttggccaagaattttgataagatggcccaaatcccaaatttccagaagaatctatcttcaagaaaggataaaattgacctgctgttcgaggagaacaacttcaagcctttcaaatacaacgatttaggcgccttagcctacctgggaagcgaaagggccattgccaccatacgtagcggtaagagaacattctacaccggcggtggcttaatgaccttctacttatggcggattttgtacctgtccatgattctatctgcaagatcgagactgaaggtcttcttcgactggattaaattagcatttttcaaaagagactttttcaaaggattatag

SEQ ID NO: 843 - DNA, 1542 bp, Artificial Sequence
  source: /note="Description of Artificial Sequence: Synthetic polynucleotide"
atgctgagcaagaatctgtatagtaacaagaggttgctgacctcgacgaataccctagtcagattcgcttccaccagatccacaggggtggaaaactccggagcaggtcctacaagctttaagaccatgaaaatcatcgaccctcagcacagcgacaaaccaaacgtgctgatactgggttcggggtggggagctatttcgtttctgaagcacattgacaccaagaagtacaacgtttccatcatctctcccagaagctatttcctgttcacccctttgttacctagcgccccagttgggacagtagacgaaaagtcaattattgagcccatcgtgaatttcgctctgaagaaaaaggggaacgtcacctactatgaggcagaagccacctctatcaaccccgacaggaacaccgttaccatcaaaagcttaagcgccgtgagccagctataccaacctgaaaaccatctagggctgcatcaggccgaacctgctgaaattaagtacgattacctgatcagtgccgtgggtgccgagcccaacacatttggaattcccggggtgactgattacggtcatttcctgaaagaaatccccaactctttggaaataagaagaacctttgccgccaatctggagaaggccaacctgctgccaaagggtgatcccgaacggagaagactgctgtccattgtcgtcgttggtggtgggcctactggcgtagaggccgctggtgagctacaggactatgtgcaccaggacctgagaaagtttctgcctgccttggccgaagaagtccagattcacttggtcgaagccctgcccatcgttttgaacatgttcgagaaaaagctgtcaagctacgcccagtcacatctggaaaacacctcgatcaaggtacatctgagaacggccgtggccaaggtggaagagaagcaattgttggccaagacgaaacacgaagacggtaagattaccgaagaaaccattccctacggtactttgatttgggccacgggtaacaaggcaagaccggtaatcacagaccttttcaagaaaattcctgagcaaaactcgtccaagagaggcttggcagtgaatgactttttgcaagtgaaaggcagcaacaacattttcgccattggtgacaacgcctttgccgggttgccaccaacagcccaagtggcgcaccaagaggccgaatatttggccaagaattttgataaaatggctcaaataccaaatttccaaaagaatctatcctcacggaaggataaaattgatctcttgttcgaggaaaacaactttaaacccttcaaatacaacgatttaggtgccctggcctacctgggaagcgaaagggccattgccaccataagaagcggtaagagaacattttacaccggcggaggcttaatgaccttctacttatggagaattttgtacctgtccatgatcctatctgcacgcagcagattaaaggtctttttcgactggattaaattagccttcttcaaaagggacttctttaaaggcctgtag

SEQ ID NO: 844 - DNA, 1542 bp, Artificial Sequence
  source: /note="Description of Artificial Sequence: Synthetic polynucleotide"
atgctgtcgaagaacttgtacagtaacaagcggttgctcacctcgacgaacaccctcgtcagattcgccagcaccagatccaccggggtcgaaaactccggagcaggccctacatcttttaagaccatgaaaatcattgaccctcagcacagcgacaagccaaacgtgctgatactgggctctgggtggggagccattagctttctgaagcacattgacaccaagaagtacaacgtttccatcatcagccctagaagctatttcttatttacgcctttgttaccttctgcaccagttggaaccgtggacgaaaagtcaattatcgagcccatcgttaactttgctctgaagaaaaaggggaacgtcacctactatgaggcagaagccacctctatcaatcccgaccggaacaccgtgaccataaaaagcctgtctgccgttagccagctataccagcctgaaaaccacctggggctgcatcaagcagaacccgccgaaattaagtacgattatctgatcagtgctgtgggtgccgaacctaacacctttggtattcctggcgtcactgattacggtcatttcctgaaagagattcccaactctttggaaatcagaagaacttttgccgccaatctagagaaggctaacctgttgccaaagggcgaccccgaaagaagaaggctgctgtccatcgtcgtggttggtggtgggcccacaggtgtagaggccgctggcgaactacaggattatgtgcaccaggacctgagaaagttcctccctgccttggccgaagaagtccagattcacctggtcgaagccctgcccatcgtgttgaatatgtttgagaaaaagctttcatcatacgcgcagtcacatttagaaaacacttcgatcaaagtacatctgagaacggctgtggccaaggttgaagagaagcagttgttggcaaagacgaaacacgaagacggcaaaattaccgaagaaaccatcccctacggtaccttgatttgggccacgggtaacaaggcaagaccggtgatcacagaccttttcaagaagattcctgagcaaaactcgagcaagcggggattggccgtgaatgactttttgcaagtgaaaggcagcaacaacattttcgccattggtgacaatgcctttgccgggttgccaccaacagcccaagtggcccaccaggaagccgaatatttggccaagaattttgacaagatggctcaaataccaaatttccaaaagaatctatcttcaagaaaggataaaattgatctcttgttcgaggagaacaacttcaaacctttcaagtacaacgacctgggtgccctggcatacctgggatccgaaagggccattgcaaccataagatccggtaagagaacattttacaccggcggtggcttaatgaccttctacttatggagaattttgtacttgtccatgatcctgtctgcaagaagcagactgaaggtgttcttcgactggattaagttagcatttttcaaaagggactttttcaaaggattatag

SEQ ID NO: 845 - DNA, 1542 bp, Artificial Sequence
  source: /note="Description of Artificial Sequence: Synthetic polynucleotide"
atgctatcgaagaacttgtatagtaacaagaggttgctcaccagcacgaacacgctcgtcagattcgctagcaccagatccacaggcgtcgaaaacagcggagcaggtcctacatcttttaagaccatgaaagtcatcgacccccagcacagcgacaaaccaaacgtgctgatactgggttcggggtggggagccattagctttctgaagcacattgacaccaagaagtacaacgtttccatcatctctcccagaagctacttcatctacacccctctgttaccttctgcaccagtggggacagtggacgagaagtcaattattgagcccatcgtgaatttcgctctcaagaaaaagggcaacgttacctactatgaggcagaagccacctctatcaatcccgacaggaacaccgtgaccataaaaagcctgagcgccgtttcccagctataccagcctgagaaccacctagggctgcaccaagcagaacccgccgagattaagtacgattacttaatcagtgctgtaggtgcggaacccaacacctttggtattcctggggtcaccgattacggtcatttcctgaaggaaattcccaactctttggaaataagaagaactttcgccgccaacctggagaaggccaacttattgccaaagggtgatcccgagagaagaaggctgctgagcattgtggtcgtgggtggtggccccactggcgtagaagctgctggcgaactgcaggactatgttcaccaggacctgagaaagtttctccctgcattggccgaagaagtccaaattcacctggtcgaagctctgcccatcgttttgaacatgtttgagaaaaagctttcaagctacgcgcaatcacatttagaaaacacttcgatcaaagtgcatctgagaacggccgtcgccaaagttgaagaaaagcagttgttggcaaagacgaaacacgaggacggtaagattaccgaagaaaccatcccctacggtactctgatttgggccaccggtaacaaggcaagacccgtaatcaccgacctgttcaagaaaattcctgagcaaaactcgtccaagagaggcttggcagtgaatgactttttgcaggtgaaaggcagcaacaacatcttcgccattggtgacaatgcatttgctggcttgccaccaaccgcccaggtggcccaccaggaggccgaatacttggccaagaattttgataaaatggctcagataccaaatttccaaaagaatctatcctccagaaaggataaaatcgatctcttgttcgaggagaacaactttaaacctttcaaatacaacgatttaggtgccttagcctacctgggatccgaaagggccattgccaccatacgttccggtaagagaaccttctacaccggtggtggcctgatgaccttctacttatggagaattctgtacctgtccatgattctatctgccagatcgagactgaaggtctttttcgactggattaaattagcatttttcaaaagggacttttttaaaggcttatga

SEQ ID NO: 846 - DNA, 1542 bp, Artificial Sequence
  source: /note="Description of Artificial Sequence: Synthetic polynucleotide"
atgctatcgaagaatttgtatagtaacaagaggttgctcacctcgacgaacacgctagtcagattcgcttccaccagatccacaggggtggaaaactccggggcaggtcccacatctttcaagaccatgaaagtcatcgaccctcagcacagcgacaagccaaacgtgctgatactgggttcggggtggggagctatttcgtttttaaagcacattgacaccaagaagtacaacgttagcatcatctctcctagaagctatttcctgtacacgcccctgctgccttctgcacctgttgggaccgtagacgaaaagtccattattgagcccatcgttaattttgctctgaagaaaaaggggaacgttacctactacgaggcagaagccacctctatcaatcccgacaggaataccgttaccataaaatcattatctgccgttagccagctgtaccaacctgaaaaccatctagggctgcaccaggccgaacccgccgaaattaagtacgattatttaatcagtgctgtaggcgccgaacctaacacatttggtattcccggcgtgactgattacggtcatttcctgaaggaaattcccaacagcttggaaataagaagaactttcgccgccaatctggagaaggctaacttactgcctaagggtgaccccgaaagaagaaggctactgtccattgtcgtggtgggcggtggccctacaggtgtagaggctgctggcgaactgcaggactatgtgcaccaggacctgagaaagtttctgcctgccttggccgaggaaatccaaattcacttggtggaagccctgcccatcgttttgaatatgttcgagaaaaagctgagctcatacgcgcagtcacacttagaaaacacttccatcaaagtacacctgagaaccgccgtggccaaagttgaagaaaagcagttgttggcaaagacgaagcacgaagacggtaaaataaccgaagaaaccattccatacggcactctgatttgggccaccggtaacaaggcaagaccggtgatcaccgaccttttcaagaaaattcctgagcaaaactcgtccaagagaggcttggcagtgaatgactttctgcaagtgaaaggcagcaacaacatcttcgccatcggtgacaacgcatttgccgggctgccaccaaccgcccaagtggcgcaccaagaagccgaatatttggccaagaattttgacaagatggcccagatacccaatttccaaaagaacctatcttccagaaaggataaaatcgatctgttgttcgaggagaacaacttcaaacccttcaaatacaacgatctgggcgccttagcatacctgggaagcgaaagggccattgcaaccatacgtagcggtaagagaacattctacaccggtggtggcttaatgaccttctacttatggcggattttgtacctgtccatgattctgtctgcacgctcgagactgaaggtgtttttcgactggattaagctggcctttttcaaaagagacttctttaaaggattatag

SEQ ID NO: 847 - DNA, 1542 bp, Artificial Sequence
  source: /note="Description of Artificial Sequence: Synthetic polynucleotide"
atgctatcgaagaatctgtacagtaacaagaggttgctcacctcgacgaacacgctagtcagattcgctagcaccagatccacaggcgtcgaaaacagcggagcaggccccacaagctttaagaccatgaaaatcattgaccctcagcacagcgacaagccaaacgtgctgatactgggttcgggctggggcgccatttcgtttttaaagcacattgacaccaagaagtacaacgtctccatcatcagccctagaagctatttcctgtacacgcctttgttaccttctgcaccagtggggaccgtagacgaaaagtcaattatcgagcccatcgttaatttcgctctcaagaaaaagggcaacgtcacctactacgaggcagaagccacctctatcaatcccgaccggaataccgttaccatcaagagcctgtctgccgttagccagctgtaccaacctgagaaccacctggggctgcatcaggcagagcctgctgaaattaagtacgattatttaatcagcgctgtaggtgcggaacctaacacatttggtattcccggcgtcaccgattacggtcatttcctgaaggaaatccccaactctttggaaatcagaagaacctttgccgccaatctggagaaggctaacttattgccaaagggtgatcccgaaagaagaagactactgtccattgtcgtggttggtggaggccctactggtgtagaggccgctggcgaactgcaggactacgttcaccaggacctgcggaagttcctccccgcattggccgaagaagtccaaattcacctggtcgaagctctgcccatcgttttgaacatgttcgagaaaaagctgagctcatacgcgcaatcacatttagaaaacacttcgatcaaagtgcacctgagaacggccgtcgccaaagttgaagaaaagcaattgttggcaaagaccaagcacgaggacggcaagataaccgaggaaaccattccatacggtactttgatttgggccacgggtaacaaggccagacccgtgatcacagaccttttcaagaagattcctgagcaaaactcgtccaagagaggcttggcagtgaacgacttcttgcaggtcaaaggcagcaacaacatcttcgccatcggtgacaacgcatttgctgggttgccaccaacagcccaggtggcgcaccaagaggccgaatatttggccaagaactttgataaaatggcccaaatacccaatttccaaaagaacctatcttcaagaaaggataaaatcgatctcttgttcgaggagaacaacttcaagcctttcaaatacaacgatttaggcgccctggcatacctgggaagcgaaagggccattgcaaccatccgtagcggtaagagaacattctacaccggtggaggcttaatgaccttctacttatggagaattctgtacttgtccatgattctatctgccagatcgagactgaaggtctttttcgactggatcaaattagcatttttcaagagagacttttttaaaggattatag

SEQ ID NO: 848 - DNA, 1542 bp, Artificial Sequence
  source: /note="Description of Artificial Sequence: Synthetic polynucleotide"
atgctatcgaagaatttgtatagtaacaagaggttgctcacctcgaccaatacgctcgtgagattcgctagcaccagatccaccggggtggaaaactccggagcaggtcccacatctttcaagaccatgaaaatcattgaccctcagcacagcgacaaaccaaacgtgctgatactgggttcggggtggggcgctatctcgtttctgaagcacattgacaccaagaagtacaacgtttccatcatctctcctagaagctacttcttatttacccccttgctgccctctgcaccagttgggaccgtagacgaaaagtcaatcatcgagcccatcgttaattttgctctgaagaaaaaggggaacgttacctactacgaggccgaagccaccagcatcaaccccgaccggaataccgtgaccatcaaatcattaagcgccgttagccagctataccagcctgaaaaccatctgggcctgcatcaagccgagcctgctgaaattaagtacgattatttaatcagcgctgtaggtgcggaacctaacacatttggtattcccggcgtgactgactacggtcacttcctgaaggagattcccaacagcttggaaataagaagaacttttgccgccaatctggagaaggccaacttattgccaaagggtgatcccgaacggagaaggctgctgagcattgtcgtggttggtggagggcctacaggtgtagaggccgctggtgaactgcaggattatgttcaccaggacctgagaaagtttctccccgcattggccgaagaaatccaaattcacttggtggaagccctgcccatcgttttgaatatgtttgagaaaaagcttagctcatacgcccagtcacacctggaaaacacttcgatcaaagtacacctgagaaccgctgtcgccaaagttgaagaaaagcagttgttggcaaagacgaaacacgaagacggtaaaataaccgaagaaactatcccatacggtaccctgatttgggccacgggtaacaaggcaagaccggtaatcacagacctgttcaagaagattcctgagcagaactcgtccaagagaggactggcagtgaatgactttctgcaagtgaaaggcagcaacaacatcttcgccatcggtgacaacgcatttgctgggttgccaccaaccgcccaagtggcgcaccaggaggccgaatatttggccaagaattttgataaaatggcccagataccaaatttccaaaagaacctatcttcacggaaggataagatcgacctcttgttcgaggaaaacaactttaaacctttcaaatacaacgatttaggcgccttagcatacctgggctccgaaagggccattgcaaccatacgtagcggtaagcggaccttttacaccggcggtggcctgatgaccttctacttatggagaattctgtacttgtccatgatcctgtctgcccgctcgagactgaaggtgttcttcgactggattaaattagcctttttcaaaagagacttctttaagggcttatga

SEQ ID NO: 849 - DNA, 1542 bp, Artificial Sequence
  source: /note="Description of Artificial Sequence: Synthetic polynucleotide"
atgctatcgaagaatttgtatagtaacaagaggttgctgacctcgacgaacacgctagtcagattcgcttccaccagatccacaggggtggaaaacagcggggcaggccctacctcttttaagaccatgaaagtcatcgaccctcagcacagcgacaagcccaacgtgctgatactgggctctgggtggggagctattagctttttaaagcacattgacaccaagaagtacaacgtttccatcatcagccctagaagctacttcatcttcacgcctttgttaccctctgcacctgttgggacagtagacgaaaagtcaatcattgagcccatcgttaattttgccctcaagaaaaaggggaacgttacctactacgaggcagaggccacctctatcaaccccgaccggaataccgttaccataaagtcattaagcgccgtttcccagctataccagcctgaaaaccacctgggcctgcatcaggcagaacctgccgaaattaagtacgattacttaatcagcgctgtaggtgcggagcctaacacatttggtattcctggggtgactgattacggtcatttcctgaaagaaattcccaactctctggaaatacggcggactttcgccgccaacctagaaaaggccaacttattgcctaagggtgatcccgaaagaagaagactactgagcatcgtcgtggttggtggtgggcccacaggtgtagaagctgctggtgaactacaggattatgttcaccaggacctgagaaagttcctgcccgcattggccgaggaaatccaaattcacttggtggaagctctgcccatcgtgctgaatatgtttgagaagaagctgagcagctacgcgcaatcacatttagaaaacacttccatcaaagtacatctgagaacggctgtggccaaggttgaagaaaagcaattgttggcaaagaccaaacacgaagacggcaagataaccgaagaaactattccatacggtactttgatttgggccacgggcaacaaggccagaccggtaatcacagaccttttcaagaaaattcccgagcagaactcgagcaagcggggattggccgtgaatgactttttgcaagtgaaaggcagcaacaacatcttcgccattggtgacaatgcctttgctgggttgccaccaaccgcccaggtggcccaccaagaggccgagtatctggccaagaactttgacaaaatggctcaaatcccaaatttccaaaagaatctatcttcacggaaggataagattgatctcttgttcgaggagaacaactttaaacccttcaaatacaacgatctgggcgccttagcctacctgggctccgaaagggccattgccaccatacgttccggtaagagaacattctacaccggtggtggcttaatgaccttctacctgtggcggattttgtacttgtccatgattctatctgcccgctcgagactgaaggtctttttcgactggattaaattagcatttttcaagagggacttttttaaaggattatag

SEQ ID NO: 850 - DNA, 1542 bp, Artificial Sequence
  source: /note="Description of Artificial Sequence: Synthetic polynucleotide"
atgctatcgaagaatttgtatagcaacaagaggttgctcacctcgacgaataccctagtccgcttcgccagcaccagatccaccggggtggaaaacagcggagctggtcctacatcttttaagaccatgaaaatcattgaccctcagcacagcgacaaacccaacgtgctgatactgggctcggggtggggcgctatttcgtttctgaagcacattgacaccaagaagtacaacgtttccatcatctctcctagaagctatttcttatacacgcctttgttaccctctgcaccagtggggaccgtagacgaaaagtccattattgagcccatcgtgaatttcgctctcaagaaaaaggggaacgtcacctactacgaggccgaagccaccagcatcaaccccgaccggaacaccgtgaccataaaatcattatctgccgttagccagctataccaacctgagaaccatctagggctgcatcaagcagagcctgctgaaattaagtacgattacttaatcagtgctgtaggtgcggaacctaacacatttggtattcccggcgtcaccgactacggtcacttcctgaaggaaattcccaacagcttggaaatacggagaactttcgccgccaacctggagaaggccaacctgctgccaaagggcgaccccgaacggagaagactactgtccattgtcgtggttggtggtggccctactggtgtagaggccgctggtgagctgcaggattacgttcaccaggacctgagaaagtttctccctgcactggccgaggaagtgcaaattcacttggtcgaagctctgcccatcgtgttgaacatgttcgagaaaaagcttagctcatacgcgcagtcacacttagaaaacacttccatcaaggtacacctgagaacggctgtcgccaaagttgaagaaaagcaattgttggccaagaccaagcacgaagacggcaagataaccgaagaaaccattccatacggtactttgatttgggccacgggtaacaaggcaagacccgtaatcacagaccttttcaagaagattcccgagcagaacagctccaagcggggcttggcagtgaatgactttctgcaagtgaaaggcagcaacaacattttcgccattggtgacaatgcatttgctgggttgccaccaacagcccaagtggcccaccaggaggccgaatatttggccaagaattttgataaaatggcccaaataccaaatttccaaaagaatctatcttcaagaaaggataagattgatctcttgttcgaggagaacaactttaaacccttcaagtacaacgatttaggtgccttagcctacctgggaagcgaaagggccattgcaaccatccgtagcggtaagagaacattctacaccggtggaggcctgatgaccttctacttatggagaattttgtacttgagcatgattctatctgcacgcagcagactgaaggtctttttcgactggatcaagttagccttcttcaaaagagacttcttcaaaggactgtag

SEQ ID NO: 851 - DNA, 1542 bp, Artificial Sequence
  source: /note="Description of Artificial Sequence: Synthetic polynucleotide"
atgctgagcaagaatctgtatagtaacaagaggttgctcacctcgacgaatacgctagtcagattcgctagcaccagatccaccggggtcgaaaactccggagcaggtcccacaagctttaagaccatgaaggtcattgaccctcagcacagcgacaaacccaacgtgctgatcctgggctcggggtggggcgccatcagctttttaaagcacattgacaccaagaagtacaacgtctccatcatctctcctagaagctatttcctgtacacgcccttgctgccctctgcacctgttgggacagtggacgaaaagtccatcatcgagcccatcgttaattttgctctcaagaaaaagggcaacgttacctactacgaggcagaagccacctctatcaatcccgaccggaataccgttaccatcaaaagcttatctgccgttagccagctataccaacctgagaaccatctgggcctgcaccaagccgaacccgccgaaattaagtacgattacttaatcagtgctgtaggtgccgagcctaacacatttggtattcctggggtcactgactacggtcatttcctgaaggaaattcccaactctttggaaataagacggacttttgccgccaatctggagaaggccaacttattgcctaagggcgatcccgaaagaagaaggctactgtccattgtggtggttggtggtgggcccacaggcgtagaggctgctggtgaactacaggattacgttcaccaggacctgagaaagtttctccctgcactggccgaagaagtccaaattcacctggtcgaagctctgcccatcgttttgaatatgtttgagaagaagctttcatcatacgcgcagtcacatttagaaaacacttccatcaaggtgcatctgagaaccgccgtggccaaagttgaagaaaagcaattgctggcaaagacgaaacacgaggacggtaaaataaccgaagaaactattccatacggcaccctgatttgggccaccggtaacaaggccagaccggtaatcacagacctgttcaagaagattcccgagcaaaacagctccaagagaggattggccgtgaatgactttttgcaagtgaaaggcagcaacaacattttcgccattggcgacaatgcatttgctgggttgcctccaaccgcccaggtggcgcaccaagaggccgagtatttggccaagaactttgataaaatggcccagataccaaatttccaaaagaatctatcttcaagaaaggataaaattgatctcttgttcgaggagaacaactttaaacccttcaaatacaacgacttaggtgccttagcctacctgggaagcgaaagagccattgccaccatccgttccggtaagcggacattctacaccggtggtggcttaatgaccttctacttatggagaattatctacttgagcatgatcctgtctgccagatcgagattaaaggtctttttcgactggattaaattagcctttttcaaaagagacttttttaaaggcttatga

SEQ ID NO: 852 - DNA, 1542 bp, Artificial Sequence
  source: /note="Description of Artificial Sequence: Synthetic polynucleotide"
atgctgagcaagaatctgtacagtaacaagaggttgctcacctcgaccaataccctcgtcagattcgctagcaccagatccacaggcgtggaaaacagcggagctggtcctacatctttcaagaccatgaaggtcattgaccctcagcacagcgacaaaccaaacgtgctgatcctgggctctgggtggggagctatttcgtttttaaagcacatcgacaccaagaagtacaacgttagcatcgtgtctcctagaagctacttcctgttcacccccctgttaccttctgccccagtggggacagtagacgaaaagtcaatcattgagcccatcgttaattttgccctcaagaaaaagggcaacgtcacctactatgaggccgaagccacctctatcaatcccgaccggaataccgttaccataaaaagcttatctgccgttagccagctataccaacccgagaaccatctagggctgcatcaagcagaacctgctgagattaagtacgattacttaatcagcgctgtgggtgccgaacctaacacatttggtattcctggggtcactgactacggccatttcctgaaagaaattcccaactctctggaaataagaagaacttttgccgccaatctagagaaggctaacctgttgccaaagggcgaccccgagagaagaagactactgagcatcgtcgtcgttggtggtgggcccacaggtgtagaagctgctggtgaactacaggactatgttcaccaggacctgagaaagtttctccccgcattggccgaagaagtccaaattcacttggtcgaagccctgcccatcgttttgaatatgttcgagaagaagctttcatcatacgcgcaatcacacctggaaaacacttcgatcaaagtacatctgagaaccgctgtcgccaaagttgaagaaaagcaattgctggccaagacgaaacacgaggacggtaaaattaccgaagaaactatcccatacggtactttgatttgggccacgggtaacaaggcaagaccggtgatcacagaccttttcaagaagattcccgagcaaaactcgtccaagagaggactggcagtgaacgactttctgcaagtgaaaggcagcaacaacattttcgccatcggtgacaatgcatttgctggcttgcctccaaccgcccaagtggcccaccaagaggccgaatacttggccaagaatttcgataagatggctcaaatacccaatttccagaagaacctatcttccagaaaggataaaattgatctgctgttcgaggagaacaactttaagcccttcaaatacaacgatctgggcgccttagcctacctgggatccgaaagggccattgcaaccatacgttccggtaagagaacattctacaccggtggtggcttaatgaccttctacttatggagaattttgtacatgtccatgatcctgtctgccagatcgagattaaaggtcttcttcgactggattaaattagcatttttcaaaagagacttctttaagggattatag

SEQ ID NO: 853 - DNA, 1542 bp, Artificial Sequence
  source: /note="Description of Artificial Sequence: Synthetic polynucleotide"
atgctgtcgaagaatttgtacagtaacaagaggttgctcacctcgaccaatacgctagtgagattcgctagcaccagatccacaggggtggaaaacagcggagcaggtcctacatcttttaagaccatgaagatcattgaccctcagcacagcgacaaaccaaacgtgctgatactgggttctgggtggggcgctatttcgtttttaaagcacatcgacaccaagaagtacaacgtctccatcatcagccctagaagctatttcctgtttacccctctgttaccttctgcaccagttgggaccgtagacgagaagtcaattattgagcccatcgtgaacttcgctctcaagaaaaagggcaacgttacctactatgaggcagaagccacctctatcaatcccgacaggaataccgtgaccataaagagcttatctgccgtgagccagctataccaacctgaaaaccatctagggctgcaccaagccgaacctgctgaaattaagtacgattacctgatcagtgccgtgggtgccgaacctaacacatttggtattcctggggtgactgactacggtcatttcctgaaagaaattcccaacagcttggaaataagaagaacttttgccgccaacctagaaaaggccaacttattgccaaagggtgatcccgaaagaagaagactactgtccatcgtcgtggttggtggtgggcctactggcgtagaagccgctggtgagctacaggattatgttcaccaggacctgagaaagtttctccccgcattggccgaagaagtccagattcacttggtggaagctctgcccatcgtgctgaatatgttcgagaaaaagcttagctcatacgcgcagtcacacctggaaaacacttccatcaaagtgcatctgagaacggctgtcgccaaagttgaagaaaagcaattgttggccaagacgaagcacgaagacggtaaaataaccgaagaaactatcccatacggtactctgatttgggccaccggtaacaaggccagaccggtgatcacagaccttttcaagaaaattcctgagcagaactcgagcaagagaggcctggcagtgaatgactttctgcaagtcaaaggcagcaacaacattttcgccatcggtgacaatgcatttgccgggttgcctcctaccgcccaggtggcgcaccaggaggccgaatacttggccaagaattttgataaaatggctcaaataccaaatttccaaaagaatctatcttccagaaaggataaaattgacctcctgttcgaggaaaacaacttcaaacccttcaagtacaacgatctgggtgccctggcatacctgggatccgaaagggccattgcaaccatacgtagcggcaagagaaccttttacaccggtggtggcttaatgaccttctacttatggagaattctgtacatgtccatgatcctaagcgcccgcagcagactgaaggtcttcttcgactggattaaattagccttcttcaagagggacttttttaaaggcttatag

SEQ ID NO: 854 - DNA, 1542 bp, Artificial Sequence
  source: /note="Description of Artificial Sequence: Synthetic polynucleotide"
atgctgagcaagaatttgtatagtaacaagaggttgctgacctcgacgaacacgctcgtgagattcgcttccaccagatccacaggcgtcgaaaactccggagctggccccacatcttttaagaccatgaaagtcattgaccctcagcacagcgacaaacccaacgtgctgatcctgggttcggggtggggcgctatttcgtttctgaagcacattgacaccaagaagtacaacgttagcatcgtgtctcctagaagctatttcttatacacgcccctgttaccttctgcaccagtggggaccgtggacgaaaagtcaattattgagcccatcgttaattttgctctgaagaaaaaggggaacgttacctactacgaggcagaagccacctctatcaatcccgacaggaataccgttaccataaagtcactgtctgccgttagccagctataccaacctgagaaccatctagggctgcaccaagccgaacccgccgagattaagtacgattacttaatcagcgccgtaggcgcggaacctaacacatttggtattcctggggtcactgattacggtcacttcctgaaagaaattcccaactctttggaaatacggcggacctttgccgccaatctagagaaggccaacttattgcctaagggcgatcccgaacggagaaggctactgtccattgtcgtcgtgggtggtggccctacaggcgtggaggccgctggcgaactacaggactatgtgcaccaggacctgagaaagtttctccccgccttggccgaagaagtgcaaattcacttggtcgaagctctgcccatcgttttgaacatgtttgagaagaagcttagctcatacgcgcaaagccatttagaaaacacttccatcaaagtacatctgagaacggctgtcgccaaagttgaagaaaagcagttgctggccaagaccaaacacgaagacggtaaaataaccgaagaaaccattccatacggtactttgatttgggccacgggtaacaaggcaagacccgtaatcaccgaccttttcaagaaaattcccgagcaaaacagctccaagcggggattggcagtgaatgacttcttgcaggtgaaaggcagcaacaacatcttcgccattggtgacaacgcctttgctggcttgcctccaaccgcccaagtggcgcaccaagaggccgaatatttggccaagaactttgataaaatggcccaaatacccaatttccaaaagaatctatcttccagaaaggataaaatcgatctgttgttcgaggagaacaactttaaacctttcaaatacaacgatttaggtgccttagcatacctgggcagcgaaagagccattgccaccataagatccggtaagagaaccttctacaccggcggaggcttaatgaccttctacctgtggagaattttgtacctgtccatgattctaagcgcacgctcgagattaaaggtcttcttcgactggatcaaattagcatttttcaaaagagacttttttaaaggattatag

SEQ ID NO: 855 - DNA, 1542 bp, Artificial Sequence
  source: /note="Description of Artificial Sequence: Synthetic polynucleotide"
atgctatcgaagaatctgtatagtaacaagcggttgctcacctcgacgaataccctagtcagattcgcttccaccagatccaccggggtcgaaaactccggagctggtcccacatctttcaagaccatgaaaatcatcgaccctcagcacagcgacaaacccaacgtgctgatactgggctcgggctggggagctatttcgtttttaaagcacattgacaccaagaagtacaacgtttccatcatctctcccagaagctatttcttatttacgcctttgttaccctctgccccagtggggacagtagacgaaaagtcaatcattgagcccatcgttaattttgctctcaagaaaaaggggaacgttacctactacgaggcagaagccaccagcatcaatcccgaccggaataccgttaccatcaagtcattatctgccgttagccagctataccagcctgaaaaccatctagggctgcatcaagccgagcctgctgaaattaagtacgattacttaatcagcgctgtaggtgcggaacctaacacatttggtattcctggggtcactgattacggccacttcctgaaggaaattcccaactctttggaaataagaagaacttttgccgccaatctagaaaaggccaacctgttgcctaagggcgaccccgaaagaagaagactactgtccattgtggtggtgggcggaggccccactggtgtggaggccgctggcgaactgcaggattacgttcaccaggacctgagaaagtttctccctgccttggccgaggaagtccaaattcacttggtcgaagccctgcccatcgtgttgaacatgttcgagaaaaagctgtcatcatacgcgcagtcacatttagaaaacacttccatcaaggtacatctgagaaccgctgtcgccaaagttgaagaaaagcaactgctggccaagaccaaacacgaggacggcaaaataaccgaagaaaccattccatacggtactttgatttgggccacgggtaacaaggccagaccggtaatcacagaccttttcaagaaaattcctgagcaaaacagctccaagcggggcttggcagtgaatgactttctgcaggtcaaaggcagcaacaacatcttcgccatcggtgacaatgcatttgccgggttgccaccaaccgcccaagtggcccaccaagaagccgaatatttggccaagaattttgataaaatggcccagatacccaatttccagaagaatctatcttccagaaaggataaaattgatctcttgttcgaggaaaacaactttaaacccttcaaatacaacgacttaggtgccttagcatacctgggcagcgaaagggccattgcaaccatcagatccggcaagagaacattttacaccggtggtggcttaatgaccttctacctgtggagaatcatctacatgtccatgattctgagcgccagatcgagattaaaggtctttttcgactggatcaagctggcatttttcaaaagagacttctttaaaggactgtga

SEQ ID NO: 856 - DNA, 1542 bp, Artificial Sequence
  source: /note="Description of Artificial Sequence: Synthetic polynucleotide"
atgctatcgaagaatctgtatagcaacaagcggttgctgacctcgacgaatacgctcgtgagattcgcctccaccagatccacaggggtggaaaacagcggagcaggtcctacatctttcaagaccatgaaggtcattgaccctcagcacagcgacaaaccaaacgtgctgatcctgggttctgggtggggagccatttcgtttttaaagcacattgacaccaagaagtacaacgttagcatcatctctcctagaagctatttcttatacacgcctctgttacctagcgcaccagttgggacagtggacgagaagtcaattattgagcccatcgttaattttgctctgaagaaaaagggcaacgttacctactatgaggccgaagccacctctatcaaccccgacaggaataccgtgaccatcaaatcattatctgccgtgagccagctataccaacccgaaaaccatctaggcctgcatcaggcagaacctgccgaaattaagtacgactatctgatcagtgctgtgggtgccgaacctaacacatttggtattcctggcgtcactgattacggtcacttcctgaaagaaatccccaactctttggaaatacggcggacctttgccgccaacctagagaaggctaacctgttgcctaagggtgaccccgaaagaagaagactactgtccattgtcgtggtgggtggtgggcccactggcgtagaggccgctggcgaactacaggactatgtgcaccaggacctgagaaagttcctccctgccctggccgaagaagtccaaattcacttggtcgaagccctgcccatcgttttgaatatgtttgagaaaaagctttcatcatacgcccaatcacatttagaaaacacttcgatcaaagtgcacctgagaacggccgtcgccaaggttgaagaaaagcaactgttggcaaagacgaaacacgaagacggtaagataaccgaagaaaccatcccatacggtactctgatttgggccaccggcaacaaggcaagaccggtgatcacagacctgttcaagaaaattcccgagcaaaactcgtccaagagaggattggcagtgaatgactttttgcaggtcaaaggcagcaacaacattttcgccatcggcgacaacgcctttgccgggttgccaccaaccgcccaagtggcgcaccaggaggccgaatatttggccaagaatttcgacaaaatggctcagatacccaatttccagaagaatctatcttcaagaaaggataagatcgatctcctgttcgaggagaacaactttaagcccttcaagtacaacgatttaggcgccttagcatacctgggctccgaaagggccattgccaccatccgttccggcaagagaacattctacaccggtggaggcttaatgaccttctacttatggagaattatctacatgtccatgatcctgtctgccagaagcagattaaaggtctttttcgactggattaaattagcatttttcaaaagagacttttttaaaggattatag

SEQ ID NO: 857 - DNA, 1542 bp, Artificial Sequence
  source: /note="Description of Artificial Sequence: Synthetic polynucleotide"
atgctaagcaagaatctgtatagtaacaagaggctgctgaccagcaccaacacgctagtgagattcgcttccaccagatccacaggggtggaaaactccggagctggccctacatcttttaagaccatgaaagtcattgaccctcagcacagcgacaaacccaacgtgctgatactgggctcggggtggggcgccatttcgtttctgaagcacattgacaccaagaagtacaacgttagcatcatctctcctagaagctatttcttatacacgcctttgttacctagcgcacctgttgggacagtagacgaaaagtccattatcgagcccatcgttaattttgccctcaagaaaaagggcaacgttacctactatgaggccgaagccacctctatcaatcccgacaggaacaccgttaccataaaatcactgtctgccgtgtcccagctgtaccagcctgagaaccatctaggcctgcatcaggcagaacccgctgagattaagtacgattatctgatcagtgccgtaggtgccgagcctaacacatttggaattcccggggtgactgattacggtcatttcctgaaggaaattcccaactctttggaaatacggcggaccttcgccgccaatctagagaaggctaacttactgccaaagggtgatcccgaacggagaaggctactgtccattgtcgtggttggcggagggcctactggcgtggaggccgctggtgaactacaggactatgttcaccaggacctgagaaagttcctccctgcattggccgaagaaatccaaattcacttggtggaagctctgcccatcgtgctgaatatgtttgagaaaaagcttagctcatacgcgcaaagccacttagaaaacacctccatcaaagtacatctgagaacggctgtcgccaaagttgaagaaaagcaattgctggcaaagaccaaacacgaggacggtaaaattaccgaagaaaccattccctacggtactttgatttgggccacgggtaacaaggccagacccgtgatcaccgaccttttcaagaaaattcctgagcaaaacagctccaagcggggattggcagtgaatgacttcttgcaggtgaaaggcagcaacaacatcttcgccattggtgacaatgcctttgctgggttgcctccaaccgcccaagtggcccaccaagaggccgaatatctggccaagaatttcgataagatggctcaaataccaaatttccaaaagaatctatcttcaagaaaggataaaattgatctgttgttcgaggaaaacaactttaagcctttcaaatacaacgatttaggtgccttagcctacctgggctccgaaagggccattgcaaccatacgttccggtaagagaacattttacaccggtggtggcctgatgaccttctacttatggcggattatctacctgtccatgattctgagcgccagatcgagattaaaggtgtttttcgactggattaaattagcctttttcaaaagggactttttcaaaggactgtag

SEQ ID NO: 858 - DNA, 1542 bp, Artificial Sequence
  source: /note="Description of Artificial Sequence: Synthetic polynucleotide"
atgctatcgaagaacttgtatagcaacaagaggttgctcacctcgaccaataccctcgtgagattcgcttccaccagatccaccggcgtcgaaaactccggagcaggtcctacatctttcaagaccatgaaagtcattgaccctcagcacagcgacaagcccaacgtgctgatactgggttcggggtggggcgccatctcgtttctgaagcacattgacaccaagaagtacaacgtttccatcgtgtctcctagaagctatttcctgttcacgcctctgttaccttctgcaccagtgggaacagtagacgaaaagtccattattgagcccatcgttaattttgctctcaagaaaaaggggaacgtcacctactatgaggccgaagccaccagcatcaaccccgacaggaacaccgttaccataaaatcattatctgccgtgagccagctgtaccaacctgaaaaccatctggggctgcatcaggcagaacctgctgaaattaagtacgattatttaatcagtgctgtaggtgcggaacctaacacctttggtattcctggggtcactgattacggccatttcctgaaggaaattcccaactctttggaaatcagacggacctttgccgccaatctagagaaggctaacctgttgccaaagggtgatcccgaacggagaagactgctgtccattgtcgtggttggcggagggcccacaggtgtagaggccgctggtgaactacaggactacgttcaccaggacctgagaaagtttctccctgccttggccgaagaaatccaaattcacttggtcgaagccctgcccatcgttttgaacatgttcgagaagaagctttcatcatacgcgcaatcacatttagaaaacacctcgatcaaagtacacctgagaacggctgtcgccaaagttgaagaaaagcagttgttggcaaagacgaaacacgaagacggcaaaattaccgaagaaactattccatacggcactttgatttgggccaccggtaacaaggccagaccggtgatcacagacctgttcaagaaaatccccgagcaaaacagctccaagagaggattggcagtgaatgacttcttgcaggtgaaaggcagcaacaacattttcgccatcggtgacaatgcatttgctgggctgcctcctacagcccaagtggcgcaccaggaggccgaatacctggccaagaatttcgataaaatggctcaaatacccaatttccaaaagaatctatcttcccggaaggataaaatcgacctcctgttcgaggagaacaacttcaaacctttcaaatacaacgacctgggtgccttagcctacctgggatccgaaagggccattgccaccataagaagcggcaagagaacattctacaccggtggtggcctgatgaccttctacttatggagaattatctacttgtccatgatcctatctgcacgcagcagactgaaggtctttttcgactggattaagttagcatttttcaaaagggactttttcaaaggcctgtag

SEQ ID NO: 859 - DNA, 1542 bp, Artificial Sequence
  source: /note="Description of Artificial Sequence: Synthetic polynucleotide"
atgctatcgaagaatttgtatagcaacaagaggctgctcaccagcaccaataccctcgtcagattcgctagcaccagatccacaggggtcgaaaactccggagctggtcctacaagcttcaagaccatgaagatcatcgacccccagcacagcgacaaacccaacgtgctgatcctgggctcggggtggggcgctatttcgtttttaaagcacattgacaccaagaagtacaacgtttccatcatctctcccagaagctatttcatctttacgcctttgctgccctctgccccagttggaacagtagacgaaaagtcaattattgagcccatcgttaatttcgctctcaagaaaaagggcaacgttacctactatgaggcagaggccacctctatcaatcccgacaggaataccgttaccataaagagcctgtctgccgtgagccagctataccagcctgaaaaccacctggggctgcatcaagcagaacccgctgaaattaagtacgactatttaatcagcgctgtaggtgcggaacccaacacctttggtatccctggggtcactgactacggtcatttcctgaaagagattcccaactctttggaaatacggagaactttcgccgccaatctagagaaggctaacttattgcctaagggcgatcccgaaagaagaagactactgtccattgtggtggtgggcggtggccccactggtgtggaggccgctggtgaactacaggactatgttcaccaggacctgagaaagttcctccccgcattggccgaggaaatccaaattcacctggtggaagctctgcccatcgtgttgaatatgtttgagaagaagctttcatcatacgcgcagtcacacttagaaaacacttcgatcaaagtgcatctgagaacggccgtcgccaaagttgaagaaaagcaattgttggcaaagacgaaacacgaagacggtaaaataaccgaagaaactattccatacggtactttgatttgggccacgggtaacaaggccagaccggtaatcacagaccttttcaagaaaatccctgagcaaaactcgtccaagcggggcttggcagtgaacgactttttgcaagtgaaaggcagcaacaacatcttcgccattggcgacaatgcatttgccgggttgcctccaaccgcccaagtggcccaccaggaggccgaatatttggccaagaatttcgataaaatggctcaaatacccaatttccagaagaatctatcctccagaaaggataaaattgacctcttgttcgaggaaaacaactttaaacctttcaagtacaacgatttaggtgccctggcatacctgggctccgaaagggccattgccaccatacgtagcggtaagagaaccttttacaccggtggaggcttaatgaccttctacctgtggagaattttgtacttgtccatgattctatctgcaagatcgagactgaaggtcttcttcgactggatcaaactggcattcttcaaaagggacttctttaaaggcttatga

SEQ ID NO: 860 - DNA, 1542 bp, Artificial Sequence
  source: /note="Description of Artificial Sequence: Synthetic polynucleotide"
atgctgagcaagaatttgtacagcaacaagaggttgctcaccagcacgaataccctagtccgcttcgcttccaccagatccaccggcgtggaaaactccggagcaggccctaccagctttaagaccatgaaagtcatcgaccctcagcacagcgacaaaccaaacgtgctgatactgggttcgggctggggcgctatttcgtttctgaagcacatcgacaccaagaagtacaacgttagcatcatctctcctagaagctatttcatctttacgcccttgttaccttctgcacctgttgggacagtagacgagaagtcaattattgagcccatcgttaattttgccctcaagaaaaaggggaacgtcacctactatgaggcagaggccacctctatcaaccccgacaggaataccgttaccataaaatcactgtctgccgtttcccagctataccagcccgaaaaccatctgggcctgcaccaagccgaacccgctgaaattaagtacgattacttaatcagtgccgtaggtgcggagcctaacacatttggtattcctggggtcactgactacggtcatttcctgaaagaaattcccaacagcttggaaataagaagaacttttgccgccaatctagagaaggccaacctgttgccaaagggtgatcccgaacggagaaggctactgtccattgtggtggttggtggtggccctactggtgtggaggctgctggtgaactacaggattatgttcaccaggacctgagaaagtttctccctgcattggccgaggaaatccagattcacttggtcgaagccctgcccatcgttctgaatatgtttgagaagaagctgtcatcatacgcccagtcacatttagaaaacacctccatcaaagtgcacctgagaacggccgtcgccaaggttgaagagaagcaattgttggccaagaccaaacacgaagacggtaaaattaccgaagaaactatcccctacggtactttgatttgggccaccggtaacaaggccagacccgtaatcacagacctgttcaagaaaattcctgagcaaaactcgagcaagagaggactggcagtgaacgacttcctgcaagtgaaaggcagcaacaacattttcgccattggcgacaacgcatttgctggcttgccacctaccgcccaggtggcgcaccaagaggccgaatatttggccaagaattttgacaaaatggctcaaatccccaatttccaaaagaatctatcctcaagaaaggataaaattgatctcttgttcgaggagaacaacttcaaacctttcaaatacaacgatttaggcgccttagcctacctgggaagcgaaagggccattgcaaccatacgttccggtaagagaacattttacaccggtggtggcttaatgaccttctacctgtggagaatcttgtacatgtccatgatcctaagcgcaagatcgagattaaaggtctttttcgactggattaaactggccttcttcaaaagagacttttttaaaggcctgtga

SEQ ID NO: 861 - DNA, 1542 bp, Artificial Sequence
  source: /note="Description of Artificial Sequence: Synthetic polynucleotide"
atgctgtcgaagaacttgtatagcaacaagaggttgctgacctcgaccaacacgctagtcagattcgcttccaccagatccacaggggtcgaaaacagcggagctggtcccacctcttttaagaccatgaaaatcattgaccctcagcacagcgacaaacccaacgtgctgatactgggttctggctggggcgctatttcgtttttaaagcacatcgacaccaagaagtacaacgtctccatcatctctcctagaagctatttcctgtacacccctttgttaccttctgcaccagttggaacagtagacgagaagtccattattgagcccatcgtgaactttgccctgaagaaaaaggggaacgttacctactacgaggcagaagccacctctatcaatcccgacaggaataccgttaccataaaatcattatctgccgttagccagctataccaacctgaaaaccatctaggcctgcaccaagcagaacccgctgagattaagtacgactacttaatcagcgctgtgggcgcggaacccaacacctttggtattcccggcgtcactgactacggccatttcctgaaggaaattcccaactctctggaaataagaagaacttttgccgccaatctagaaaaggctaacttattgccaaagggtgatcccgaacggagaagactactgagcatcgtggtggttggtggtgggcccactggtgtggaggccgctggtgagctacaggattacgttcaccaggacctgagaaagtttctgcctgcattggccgaagaagtccaaattcacctggtcgaagctctgcccatcgtgttgaatatgtttgagaagaagctgtcaagctacgcgcaatcacatctggaaaacacctccatcaaagtgcacctgagaaccgccgtcgccaaggttgaagaaaagcaattgctggcaaagacgaaacacgaagacggtaaaataaccgaagaaactattccctacggcactctgatttgggccaccggtaacaaggcaagacccgtaatcacagacctgttcaagaaaattcctgagcaaaactcgagcaagcggggattggcagtgaatgactttttgcaggtgaaaggcagcaacaacatcttcgccattggcgacaatgcctttgccgggttgcctccaaccgcccaagtggcccaccaagaggccgaatatttggccaagaattttgataaaatggcccagataccaaatttccaaaagaatctatcttcaagaaaggataagatcgatctgttgttcgaggaaaacaacttcaaacctttcaaatacaacgacttaggtgccttagcatacctgggatccgaaagagccattgcaaccatacgtagcggtaagagaacattttacaccggtggtggcttaatgaccttctacttatggagaattttgtacatgtccatgattctgtctgccagatcgagattaaaggtgtttttcgactggattaaactggcctttttcaagagagacttctttaaaggattatga

SEQ ID NO: 862 - DNA, 1542 bp, Artificial Sequence
  source: /note="Description of Artificial Sequence: Synthetic polynucleotide"
atgctaagcaagaatctgtatagcaacaagaggttgctcacctcgacgaatacgctagtcagattcgctagcaccagatccacaggggtcgaaaacagcggagcaggtcctacctcttttaagaccatgaagatcattgaccctcagcacagcgacaaaccaaacgtgctgatcctgggctcggggtggggagctatttcgtttttaaagcacattgacaccaagaagtacaacgtctccatcatctctcccagaagctatttcctgtttacccctctgttaccttctgcaccagttggaacagtagacgaaaagtccattattgagcccatcgtgaactttgctctcaagaaaaagggcaacgttacctactatgaggcagaagccacctctatcaatcccgacaggaacaccgttaccatcaagagcttaagcgccgttagccagctataccagcctgaaaaccacctagggctgcatcaagcagagcccgctgaaattaagtacgactatctgatcagtgccgtaggcgcggaacctaacacatttggaattcctggggtcactgattacggtcacttcctgaaagagattcccaactctttggaaataagacggacttttgccgccaatctagaaaaggctaacttattgcctaagggcgaccccgagagaagaaggctactgtccattgtcgtggttggtggtgggcctactggcgtagaagccgctggtgaactacaggattatgttcaccaggacctgagaaagtttctgcctgccctggccgaggaaatccagattcacctggtggaagctctgcccatcgttctgaacatgtttgagaaaaagctgtcatcatacgcccaatcacacttagaaaacacttcgatcaaagtgcatctgagaacggccgtcgccaaggttgaagagaagcaactgttggcaaagaccaaacacgaagacggcaagattaccgaggaaactattccctacggtactttgatttgggccacgggtaacaaggccagaccggtaatcacagacctgttcaagaaaattcccgagcaaaactcgtccaagagaggcttggcagtgaatgactttttgcaggtcaaaggcagcaacaacattttcgccattggtgacaacgcctttgccgggctgcctccaaccgcccaagtggcgcaccaagaggccgaatatttggccaagaattttgacaaaatggcccaaataccaaatttccaaaagaatctatcttccagaaaggataaaattgacctgctgttcgaggagaacaactttaaacccttcaaatacaacgatttaggcgccctggcatacctgggctccgaaagggccattgcaaccatcagatccggtaagagaacattttacaccggcggtggcttaatgaccttctacttatggagaatcctgtacatgtccatgattctatctgcaagatcgagactgaaggtgtttttcgactggatcaaattagcatttttcaaaagagacttttttaaaggactgtga

SEQ ID NO: 863 - DNA, 1542 bp, Artificial Sequence
  source: /note="Description of Artificial Sequence: Synthetic polynucleotide"
atgctgagcaagaatttgtatagtaacaagaggttgctgaccagcaccaacaccctagtcagattcgccagcaccagatccacaggcgtggaaaacagcggagcaggtcctacatcttttaagaccatgaagatcatcgaccctcagcacagcgacaaaccaaacgtgctgatactgggttctgggtggggagctatttcgtttttaaagcacatcgacaccaagaagtacaacgtttccatcatctctcctagaagctatttcatcttcacccccctgttaccctctgcccctgttggaacagtagacgaaaagtccattatcgagcccatcgttaattttgctctcaagaaaaagggcaacgtcacctactatgaggcagaagccacctctatcaatcccgaccggaacaccgttaccataaaatcactgagcgccgttagccagctataccaacccgagaaccatctagggctgcatcaagccgaacctgctgaaattaagtacgattatctgatcagtgccgtaggtgcggagcctaacacatttggtattcccggggtgactgattacggccatttcctgaaggaaatccccaactctttggaaataagaagaacttttgccgccaacctggagaaggctaacttattgcctaagggcgatcccgaacggagaagactactgtccatcgtcgtcgttggcggtgggcctactggtgtagaggctgctggtgaactgcaggattatgttcaccaggacctgcggaagtttctccccgccttggccgaagaagtgcaaattcacttggtggaagccctgcccatcgtgttgaacatgtttgagaaaaagcttagctcatacgcccagagccatttagaaaacacttcgatcaaagtacatctgagaaccgccgtcgccaaggttgaagagaagcaattgttggcaaagacgaaacacgaagacggtaaaattaccgaagaaaccattccctacggtactttgatttgggccacgggtaacaaggccagacccgtgatcaccgaccttttcaagaagattcctgagcaaaactcgtccaagagaggcttggccgtgaatgactttttgcaggtcaaaggcagcaacaacattttcgccattggtgacaatgcctttgccgggttgccaccaaccgcccaagtggcgcaccaggaagccgaatatttggccaagaactttgacaaaatggcccaaataccaaatttccagaagaatctatcttcaagaaaggataaaattgacctcttgttcgaggagaacaactttaaacctttcaaatacaacgatttaggtgccttagcatacctgggatccgaaagggccattgcaaccataagatccggtaagagaacattctacaccggtggtggcttaatgaccttctacctgtggagaattatctacttgtccatgattctgagcgcccgctcgagattaaaggtctttttcgactggatcaagttagcattcttcaaaagggacttttttaaaggattatag

SEQ ID NO: 864 - DNA, 1542 bp, Artificial Sequence
  source: /note="Description of Artificial Sequence: Synthetic polynucleotide"
atgctgagcaagaatttgtatagtaacaagaggttgctcacctcgacgaacacgctcgtgagattcgcttccaccagatccacaggcgtggaaaactccggagcaggccctacatcttttaagaccatgaaaatcattgaccctcagcacagcgacaaacccaacgtgctgatactgggttcggggtggggagctatttcgtttctgaagcacatcgacaccaagaagtacaacgtctccatcatctctcctagaagctatttcatctacacgcccctgttaccttctgcaccagtggggacagtagacgagaagtcaatcattgagcccatcgttaatttcgctctcaagaaaaagggcaacgttacctactacgaggcagaagccacctctatcaatcccgacaggaacaccgtgaccataaaatcactgtctgccgttagccagctataccaacctgagaaccatctagggctgcatcaggcagaacctgctgaaattaagtacgattatctgatcagcgccgtaggcgcggagcctaacacctttggtatccctggcgtgactgattacggtcatttcctgaaggagattcccaacagcttggaaatcagaagaactttcgccgccaacctagagaaggccaacttattgccaaagggcgatcccgaaagaagaaggctactgtccatcgtcgtggttggtggaggccctactggtgtggaggccgctggtgagctacaggattatgttcaccaggacctgagaaagtttctgcccgccttggccgaagaagtccaaattcacttggtcgaagccctgcccatcgtgttgaacatgtttgagaaaaagctttcatcatacgcccaatcacatttagaaaacacctcgatcaaagtacatctgagaaccgctgtcgccaaagttgaagagaagcaattgctggcaaagacgaaacacgaagacggtaagattaccgaagaaactattccatacggcactctgatttgggccacgggcaacaaggcaagaccggtaatcacagaccttttcaagaaaattcccgagcagaacagctccaagagaggattggccgtgaacgacttcctgcaagtcaaaggcagcaacaacattttcgccattggtgacaatgcatttgctggcctgccaccaaccgcccaagtggcccaccaggaggccgagtatttggccaagaattttgataagatggctcaaatacccaatttccaaaagaatctatcctcacggaaggataagattgatctgttgttcgaggagaacaactttaaacctttcaaatacaacgacctgggtgccttagcatacctgggaagcgaaagggccattgcaaccatccgttccggtaagagaaccttttacaccggtggaggcttaatgaccttctacttatggagaatcttgtacttgtccatgatcctgtctgccagatcgagattaaaggtcttcttcgactggattaagttagcctttttcaagagagactttttcaagggactgtag

SEQ ID NO: 865 - DNA, 1542 bp, Artificial Sequence
  source: /note="Description of Artificial Sequence: Synthetic polynucleotide"
atgctgtcgaagaatctgtatagtaacaagaggttgctgacctcgacgaatacgctcgtcagattcgcttccaccagatccacaggcgtcgaaaacagcggagctggtcccacaagcttcaagaccatgaagatcattgacccccagcacagcgacaaacccaacgtgctgatcctgggttcgggctggggcgctattagctttttaaagcacattgacaccaagaagtacaacgtctccatcgtgtctcctagaagctatttcttatacacgcctttgctgccctctgcaccagtgggaaccgtggacgagaagtcaattatcgagcccatcgtgaacttcgctctcaagaaaaaggggaacgttacctactatgaggccgaagccaccagcatcaatcccgacaggaacaccgttaccataaaaagcttatctgccgttagccagctataccaacctgagaaccacctgggcctgcatcaagcagagcctgccgaaattaagtacgattacttaatcagtgctgtaggcgcggaacccaacacatttggtatccctggggtcactgattacggtcatttcctgaaagagattcccaactctttggaaataagaagaacttttgccgccaacctagagaaggctaacttattgccaaagggtgaccccgaaagaagaagactactgagcatcgtcgtggtgggcggtggccccactggtgtagaggccgctggtgaactacaggattatgttcaccaggacctgagaaagtttctccctgcattggccgaagaagtccaaattcacttggtggaagccctgcccatcgttttgaatatgtttgagaaaaagcttagcagctacgcgcagtcacatctggaaaacacctcgatcaaagtacacctgagaacggccgtggccaaagttgaagaaaagcaactgttggccaagaccaaacacgaagacggtaaaataaccgaggaaactattccatacggtactctgatttgggccacgggcaacaaggccagacccgtaatcacagaccttttcaagaaaatccctgagcaaaactcgtccaagcggggattggcagtgaatgactttttgcaagtcaaaggcagcaacaacatcttcgccattggtgacaatgcatttgctgggttgcctccaaccgcccaagtggcgcaccaggaggccgaatatttggccaagaatttcgacaagatggctcaaatacccaatttccaaaagaacctatcttcacggaaggataaaatcgacctcctgttcgaggagaacaacttcaaacctttcaaatacaacgatttaggtgccttagcatacctgggcagcgaaagggccattgcaaccatccgttccggtaagcggaccttttacaccggtggaggcttaatgaccttctacttatggagaatcttgtacatgtccatgattctatctgccagaagcagactgaaggtctttttcgactggattaaattagcatttttcaaaagagacttttttaagggattatga

SEQ ID NO: 866 - DNA, 1542 bp, Artificial Sequence
  source: /note="Description of Artificial Sequence: Synthetic polynucleotide"
atgctatcgaagaacttgtatagcaacaagcggttgctcacctcgacgaatacgctagtcagattcgcttccaccagatccacaggggtcgaaaacagcggagcaggtcccacatctttcaagaccatgaaggtcatcgaccctcagcacagcgacaaacccaacgtgctgatcctgggttctgggtggggagctatttcgtttttaaagcacattgacaccaagaagtacaacgtttccatcgtgtctcccagaagctacttcatctacacccccttgttaccttctgcaccagtgggaacagtagacgaaaagtcaatcattgagcccatcgttaatttcgccctcaagaaaaagggcaacgttacctactatgaggcagaagccacctctatcaatcccgacaggaacaccgttaccataaagtcattaagcgccgtttcccagctgtaccaacccgaaaaccacctagggctgcatcaagcagagcccgctgagattaagtacgattatttaatcagtgctgtaggtgccgaacctaacacatttggaattcccggcgtcactgattacggtcacttcctgaaggaaattcccaactctttggaaatacggcggaccttcgccgccaatctagagaaggctaacttattgcctaagggtgaccccgaaagaagaaggctactgtccattgtcgtggttggtggtggccctactggtgtagaagccgctggtgagctacaggattacgtgcaccaggacctgagaaagttcctgcctgccttggccgaagaaatccaaattcacttggtcgaagctctgcccatcgtgttgaacatgtttgagaaaaagctgagctcatacgcgcagagccacctggaaaacacctccatcaaagtacatctgagaacggctgtcgccaaggttgaagagaagcaattgctggcaaagaccaaacacgaggacggcaaaataaccgaagaaactattccatacggtactttgatttgggccacgggcaacaaggcaagaccggtgatcacagaccttttcaagaaaattcctgagcagaactcgtccaagagaggattggcagtgaatgacttcttgcaagtgaaaggcagcaacaacatcttcgccattggcgacaatgcatttgctgggctgcctccaacagcccaggtggcgcaccaggaggccgaatatctggccaagaactttgacaaaatggcccagatacccaatttccaaaagaacctatcttcaagaaaggataaaatcgatctcctgttcgaggagaacaactttaaacctttcaaatacaacgatctgggtgccttagcatacctgggctccgaaagggccattgcaaccatacgttccggtaagagaacattctacaccggtggtggcctgatgaccttctacttatggagaattctgtacttgtccatgatcctgtctgcacgctcgagactgaaggtgtttttcgactggattaaattagcatttttcaaaagagacttctttaaaggattatag

SEQ ID NO: 867 - DNA, 1542 bp, Artificial Sequence
  source: /note="Description of Artificial Sequence: Synthetic polynucleotide"
atgctatcgaagaatctgtatagtaacaagaggttgctcacctcgacgaatacgctcgtcagattcgcctccaccagatccacaggcgtggaaaactccggagcaggtcctacctctttcaagaccatgaaggtcatcgacccccagcacagcgacaaacccaacgtgctgatactgggttctggctggggagccatttcgtttttaaagcacattgacaccaagaagtacaacgtttccatcgtgagccctagaagctatttcatcttcacgcccttgctgcctagcgcaccagtgggaaccgtggacgaaaagtcaattatcgagcccatcgtgaacttcgccctcaagaaaaagggcaacgttacctactatgaggcagaggccaccagcatcaaccccgaccggaataccgttaccataaaatcattaagcgccgttagccagctataccaacctgagaaccatctagggctgcaccaggcagagcctgccgaaattaagtacgattatttaatcagtgccgtaggcgcggaacctaacacatttggtattcctggggtcaccgattacggtcatttcctgaaagaaattcccaactctctggaaatccggagaacttttgccgccaacctagagaaggccaacttattgcctaagggtgatcccgagcggagaagactgctgtccattgtcgtggtgggtggtgggcctactggtgtagaggctgctggtgaactacaggattatgttcaccaggacctgagaaagtttctccccgcattggccgaagaaatccagattcacctggtcgaagctctgcccatcgttttgaacatgtttgagaaaaagcttagctcatacgcgcaatcacacctggaaaacacctccatcaaagtacatctgagaaccgccgtcgccaaggttgaagaaaagcagctgttggccaagaccaaacacgaagacggtaaaattaccgaagaaactattccatacggtactttgatttgggccacgggtaacaaggcaagacccgtgatcacagaccttttcaagaagattcccgagcagaactcgtccaagagaggattggcagtgaatgactttctgcaagtgaaaggcagcaacaacatcttcgccattggtgacaacgcatttgctgggttgccacctaccgcccaggtggcgcaccaagaagccgaatatttggccaagaattttgacaaaatggctcaaatcccaaatttccaaaagaacctatcctcaagaaaggataaaattgatctcttgttcgaggaaaacaacttcaagcctttcaaatacaacgacttaggtgccttagcctacctgggaagcgaaagggccattgccaccatccgttccggtaagagaacattttacaccggtggtggcttaatgaccttctacttatggcggattatctacttgtccatgattctgtctgcaagatcgagattaaaggtgtttttcgactggattaagttagcattcttcaaaagagacttttttaagggactgtag

SEQ ID NO: 868 - DNA, 1542 bp, Artificial Sequence
  source: /note="Description of Artificial Sequence: Synthetic polynucleotide"
atgctgagcaagaacctgtacagcaacaagcggttgctcacctcgacgaacaccctagtccgcttcgcttccaccagatccacaggggtcgaaaactccggagcaggtcctaccagcttcaagaccatgaaagtcattgaccctcagcacagcgacaagccaaacgtgctgatactgggttctgggtggggcgccatttcgtttttaaagcacattgacaccaagaagtacaacgtttccatcgtgtctcctagaagctacttcatctttacccctttgctgccttctgcaccagttgggacagtggacgaaaagtcaattatcgagcccatcgtgaattttgccctcaagaaaaaggggaacgtcacctactatgaggcagaagccacctctatcaatcccgacaggaataccgttaccataaaaagcttaagcgccgttagccagctgtaccaacctgagaaccacctagggctgcatcaagcagagcccgctgagattaagtacgattatttaatcagtgctgtaggtgccgagcctaacacatttggtattcctggggtcactgattacggtcatttcctgaaggaaattcccaactctttggaaatcagacggacctttgccgccaatctagagaaggccaacttattgccaaagggtgatcccgaaagaagaagactactgagcattgtcgtggtgggtggagggcctacaggtgtagaagctgctggtgaactacaggattacgttcaccaggacctgcggaagtttctccctgcactggccgaagaaatccaaattcacttggtggaagctctgcccatcgttctgaatatgttcgagaaaaagctttcatcatacgcccaatcacacttagaaaacacttcgatcaaagtacatctgagaacggctgtggccaaagtggaagagaagcaattgttggcaaagacgaaacacgaggacggtaagataaccgaggaaaccattccctacggtactctgatttgggccacgggtaacaaggcaagacccgtaatcaccgaccttttcaagaaaattcctgagcagaactcgagcaagagaggattggcagtgaatgactttttgcaagtgaaaggcagcaacaacattttcgccatcggcgacaatgcatttgccggcctgccaccaacagcccaagtggcccaccaagaggccgaatatttggccaagaatttcgacaaaatggctcagataccaaatttccagaagaatctatcctccagaaaggataaaattgatctcctgttcgaggaaaacaactttaagcccttcaaatacaacgatttaggcgccttagcctacctgggcagcgaaagagccattgccaccatccgttccggcaagagaaccttctacaccggcggtggcttaatgaccttctacttatggagaattttgtacatgtccatgattctgtctgcaagatcgagattaaaggtctttttcgactggattaagctggcattcttcaaaagagacttctttaaaggattatag

SEQ ID NO: 869 - DNA, 1542 bp, Artificial Sequence
  source: /note="Description of Artificial Sequence: Synthetic polynucleotide"
atgctgtcgaagaatttgtatagtaacaagcggctgctcaccagcacgaatacgctagtcagattcgccagcaccagatccaccggggtggaaaactccggggcaggtcctacatcttttaagaccatgaaagtcattgacccccagcacagcgacaaaccaaacgtgctgatactgggttctgggtggggagccatcagctttttaaagcacattgacaccaagaagtacaacgtcagcatcatctctcccagaagctatttcatctacacgcctttgttaccctctgcccctgtggggacagtagacgagaagtcaatcattgagcccatcgttaattttgctctgaagaaaaaggggaacgtcacctactacgaggcagaagccacctctatcaatcccgaccggaacaccgttaccatcaagtcattaagcgccgtgagccagctgtaccaacccgaaaaccacctggggctgcaccaagcagaacctgctgaaattaagtacgattatttaatcagcgctgtaggtgcggaacctaacacatttggtattcccggggtcaccgattacggtcatttcctgaaggagattcccaacagcctggaaataagacggacttttgccgccaatctagagaaggctaacttattgccaaagggtgatcccgaaagaagaaggctactgtccatcgtggtggttggtggagggcccactggcgtagaggctgctggtgaactgcaggattatgtgcaccaggacctgagaaagtttctgcctgcattggccgaagaaatccaaattcacttggtcgaagctctgcccatcgttttgaacatgtttgagaaaaagctttcatcatacgcccaaagccacttagaaaacacctcgatcaaagtacatctgagaacggctgtcgccaaagttgaagaaaagcaattgttggcaaagaccaaacacgaagacggtaaaataaccgaggaaactattccctacggtactttgatttgggccacgggtaacaaggcaagacccgtaatcacagaccttttcaagaaaattcccgagcaaaactcgagcaagagaggattggccgtgaacgactttttgcaagtgaaaggcagcaacaacattttcgccattggtgacaacgcctttgccggcttgccacctacagcccaggtggcgcaccaagaggccgaatatttggccaagaacttcgataaaatggctcaaatacccaatttccaaaagaatctgtcctccagaaaggataagattgatctgttgttcgaggagaacaactttaagcctttcaaatacaacgacttaggcgccctggcatacctgggatccgaaagggccattgcaaccatccgttccggcaagagaaccttttacaccggcggtggcttaatgaccttctacttatggagaattatctacttgagcatgatcctatctgcaagatcgagactgaaggtgtttttcgactggatcaaattagcattcttcaaaagagacttctttaaaggactgtag

SEQ ID NO: 870 - DNA, 1542 bp, Artificial Sequence
  source: /note="Description of Artificial Sequence: Synthetic polynucleotide"
atgctatcgaagaatttgtacagtaacaagcggctgctcacctcgacgaacaccctagtgagattcgcttccaccagatccaccggggtcgaaaactccggagcaggtcctacctcttttaagaccatgaaaatcatcgaccctcagcacagcgacaaaccaaacgtgctgatcctgggttcgggctggggagctattagctttttaaagcacattgacaccaagaagtacaacgtcagcatcatcagccccagaagctacttcatctacacgcctttgctgccttctgcaccagttgggacagtggacgaaaagtcaattattgagcccatcgttaacttcgctctcaagaaaaaggggaacgttacctactacgaggcagaagccaccagcatcaaccccgacaggaataccgtgaccataaaaagcttaagcgccgtttcccagctataccaacccgagaaccatctagggctgcatcaagcagaacctgctgaaattaagtacgattacttaatcagtgctgtaggtgcggagcctaacacctttggaattcctggcgtcactgattacggtcacttcctgaaggaaatccccaacagcctggaaataagacggacttttgccgccaacctagagaaggccaacttattgccaaagggtgatcccgagagaagaagactactgtccatcgtcgtggtgggcggagggcccactggtgtagaggccgctggcgaactgcaggattatgtgcaccaggacctgagaaagtttctccctgcactggccgaagaagtccaaattcacttggtcgaagctctgcccatcgttttgaatatgttcgagaaaaagctgagcagctacgcgcaatcacatttagaaaacacttcgatcaaagtacatctgagaacggccgtcgccaaagtggaagaaaagcaattgttggccaagacgaagcacgaagacggtaagataaccgaagaaactatcccatacggtactttgatttgggccacgggtaacaaggcaagaccggtaatcacagaccttttcaagaaaattcctgagcaaaactcgagcaagcggggcctggcagtgaatgactttttgcaagtgaaaggcagcaacaacatcttcgccattggcgacaacgcatttgctgggttgccaccaaccgcccaagtggcgcaccaagaggccgaatatctggccaagaacttcgataaaatggcccagataccaaatttccaaaagaacctatcctcaagaaaggataaaatcgatctcctgttcgaggagaacaactttaaacccttcaaatacaacgatttaggtgccttagcatacctgggatccgaaagagccattgccaccataagaagcggcaagagaaccttctacaccggcggtggcttaatgaccttctacctgtggagaatcttgtacatgagcatgattctgtctgcaagaagcagattaaaggtctttttcgactggatcaaactggcatttttcaagagggacttcttcaaaggattatga

SEQ ID NO: 871 - DNA, 1542 bp, Artificial Sequence
  source: /note="Description of Artificial Sequence: Synthetic polynucleotide"
atgctgtcgaagaatttgtatagtaacaagaggctgctcacctcgacgaatacgctagtgagattcgcctccaccagatccaccggcgtggaaaactccggggcaggtcctacatctttcaagaccatgaaaatcattgacccccagcacagcgacaaaccaaacgtgctgatactgggttcgggctggggagctatttcgtttttaaagcacatcgacaccaagaagtacaacgttagcatcatctctcctagaagctatttcatctttacgcccttgttacctagcgcaccagttggaacagtagacgagaagtcaattatcgagcccatcgttaatttcgccctcaagaaaaagggcaacgttacctactacgaggccgaggccacctctatcaaccccgaccggaataccgtgaccataaaatcattaagcgccgtttcccagctataccaacctgagaaccacctagggctgcatcaggcagagcccgctgaaattaagtacgactatttaatcagcgctgtaggcgcggaacccaacacatttggtatccccggggtcactgattacggtcatttcctgaaggaaattcccaactctttggaaataagaagaacctttgccgccaatctggaaaaggctaacttattgcctaagggtgatcccgagcggagaagactactgtccatcgtcgtggttggtggtgggcctactggcgtagaggctgctggtgaactacaggattatgttcaccaggacctgagaaagtttctccctgcactggccgaagaagtccaaattcacctggtggaagccctgcccatcgtgctgaatatgtttgagaaaaagctgtcatcatacgcgcaaagccacttagaaaacacttcgatcaaagtacatctgagaacggccgtcgccaaggttgaagaaaagcaattgctggcaaagacgaaacacgaagacggtaaaattaccgaagaaactattccatacggtaccttgatttgggccaccggtaacaaggcaagacccgtaatcaccgaccttttcaagaaaattcctgagcaaaactcgagcaagcggggattggccgtgaatgacttcctgcaagtgaaaggcagcaacaacattttcgccatcggcgacaatgcatttgctgggttgcctcctacagcccaagtggcgcaccaagaggccgaatatttggccaagaactttgataagatggcccaaataccaaatttccaaaagaacctgtcttcaagaaaggataaaatcgatctgttgttcgaggagaacaacttcaagcctttcaagtacaacgatttaggtgccttagcctacctgggctccgaaagagccattgcaaccataagatccggtaagagaacattttacaccggcggaggcttaatgaccttctacttatggcggattatctacatgagcatgattctaagcgccagatcgagattaaaggtctttttcgactggattaagttagcatttttcaaaagggacttttttaagggattatga

SEQ ID NO: 872 - DNA, 1542 bp, Artificial Sequence
  source: /note="Description of Artificial Sequence: Synthetic polynucleotide"
atgctatcgaagaacctgtatagcaacaagaggttgctcacctcgacgaataccctcgtccgcttcgctagcaccagatccacaggcgtggaaaacagcggagctggtcccacctcttttaagaccatgaaaatcattgaccctcagcacagcgacaaaccaaacgtgctgatcctgggttcggggtggggagctattagctttttaaagcacattgacaccaagaagtacaacgtttccatcgtgagccctagaagctatttcttattcacgcccttgttaccttctgcaccagttgggaccgtagacgagaagtcaattattgagcccatcgttaattttgccctcaagaaaaaggggaacgtcacctactatgaggcagaagccaccagcatcaatcccgaccggaataccgttaccatcaaaagcttaagcgccgtgagccagctataccaacccgaaaaccacctaggcctgcatcaggcagaacctgctgaaattaagtacgattatctgatcagtgctgtaggcgcggaacccaacacatttggtattcctggcgtcactgattacggtcacttcctgaaagaaattcccaacagcttggaaatccggcggacttttgccgccaatctagagaaggccaacctgttgccaaagggtgaccccgaaagaagaagactactgagcatcgtggtggttggtggtgggcccactggtgtagaggctgctggtgaactacaggactacgtgcaccaggacctgagaaagtttctgcctgcattggccgaggaagtccaaattcacctggtggaagccctgcccatcgttttgaatatgtttgagaagaagcttagctcatacgcgcaatcacacctggaaaacacttcgatcaaagtacacctgagaacggctgtcgccaaagttgaagaaaagcagttgctggcaaagacgaaacacgaagacggtaaaattaccgaagaaactatcccatacggcactctgatttgggccacgggcaacaaggccagaccggtaatcacagaccttttcaagaaaatccctgagcaaaactcgtccaagagaggattggcagtgaatgactttctgcaagtgaaaggcagcaacaacattttcgccattggtgacaatgcatttgctggcttgccaccaaccgcccaagtggcgcaccaagaagccgaatatttggccaagaatttcgataaaatggcccaaataccaaatttccaaaagaatctatcctcaagaaaggataaaatcgatctgttgttcgaggagaacaactttaaacctttcaaatacaacgacctgggtgccttagcatacctgggaagcgaaagggccattgcaaccataagaagcggtaagagaaccttctacaccggcggaggcctgatgaccttctacttatggagaatcatctacatgtccatgattctatctgcccgcagcagattaaaggtgtttttcgactggattaaattagcctttttcaaaagggacttctttaagggcttatga

SEQ ID NO: 873 - DNA, 1542 bp, Artificial Sequence
  source: /note="Description of Artificial Sequence: Synthetic polynucleotide"
atgctatcgaagaatttgtatagtaacaagcggctgctcacctcgacgaataccctcgtccgcttcgctagcaccagatccacaggggtggaaaactccggagcaggtcctacatctttcaagaccatgaaagtcatcgaccctcagcacagcgacaagccaaacgtgctgatcctgggttcgggctggggagctattagctttttaaagcacatcgacaccaagaagtacaacgtttccatcatctctcctagaagctacttcatctacacccctttgttaccttctgcaccagttgggacagtagacgaaaagtcaattattgagcccatcgttaactttgccctgaagaaaaaggggaacgttacctactatgaggcagaagccacctctatcaatcccgacaggaataccgttaccatcaaatcactgtctgccgttagccagctataccaacctgaaaaccatctagggctgcatcaagcagaacccgccgagattaagtacgattacttaatcagtgctgtaggcgcggaacctaacacatttggaattcccggggtgactgattacggtcacttcctgaaggaaatccccaactctctggaaatcagacggacttttgccgccaacctagagaaggctaacctgttgcctaagggtgatcccgaaagaagaaggctactgtccatcgtggtggttggtggtgggcctacaggtgtggaggctgctggcgaactacaggactatgttcaccaggacctgcggaagtttctccctgcattggccgaggaaatccaaattcacttggtggaagctctgcccatcgttttgaatatgttcgagaagaagctttcatcatacgcccagagccatctggaaaacacttcgatcaaggtgcatctgagaaccgctgtcgccaaggttgaagaaaagcaattgctggcaaagacgaaacacgaggacggtaaaattaccgaggaaactattccatacggtaccctgatttgggccacgggcaacaaggcaagaccggtaatcacagacctgttcaagaagattcctgagcaaaactcgagcaagagaggcttggcagtgaatgactttctgcaagtgaaaggcagcaacaacattttcgccattggcgacaatgcatttgctgggttgccaccaacagcccaggtggcccaccaagaagccgaatatctggccaagaatttcgataagatggcccagatcccaaatttccaaaagaacctgtcttcaagaaaggataaaatcgatctcttgttcgaggagaacaactttaaacccttcaaatacaacgacttaggcgccttagcatacctgggctccgaaagggccattgcaaccataagatccggtaagagaacattctacaccggcggtggcttaatgaccttctacctgtggagaattctgtacatgtccatgattctaagcgccagaagcagattaaaggtgtttttcgactggattaaattagcatttttcaaaagggacttttttaaaggactgtag

SEQ ID NO: 874 - DNA, 1542 bp, Artificial Sequence
  source: /note="Description of Artificial Sequence: Synthetic polynucleotide"
atgctaagcaagaatttgtatagtaacaagaggttgctcacctcgaccaacacgctcgtccgcttcgcttccaccagatccacaggggtggaaaactccggagctggccctacatctttcaagaccatgaagatcattgacccccagcacagcgacaagccaaacgtgctgatcctgggttcggggtggggagctatctcgtttttaaagcacattgacaccaagaagtacaacgtctccatcgtgagccctagaagctatttcatctttacccctttgttacctagcgcccctgttggaacagtagacgagaagtcaattattgagcccatcgtgaactttgctctcaagaaaaaggggaacgttacctactacgaggcagaagccacctctatcaaccccgaccggaataccgttaccataaagagcttatctgccgtgtcccagctataccaacccgaaaaccatctgggcctgcatcaagcagaacccgccgagattaagtacgactatttaatcagtgctgtgggtgccgaacccaacacatttggaattcctggggtcactgactacggccatttcctgaaggaaattcccaactctttggaaatccggcggacttttgccgccaatctagaaaaggctaacttactgccaaagggtgatcccgagcggagaagactgctgtccattgtcgtcgttggtggtgggcctactggtgtagaggccgctggtgaactgcaggattatgttcaccaggacctgcggaagtttctccctgcactggccgaagaaatccaaattcacctggtcgaagccctgcccatcgtgttgaatatgtttgagaagaagctttcaagctacgcccaatcacatttagaaaacacttcgatcaaagtacatctgagaaccgccgtcgccaaagtggaagaaaagcaattgttggcaaagacgaagcacgaagacggcaaaataaccgaagaaaccattccatacggtactttgatttgggccaccggtaacaaggcaagacccgtaatcacagaccttttcaagaagattcctgagcaaaacagcagcaagagaggcttggcagtgaacgactttctgcaggtgaaaggcagcaacaacattttcgccattggtgacaacgcctttgctgggttgcctcctaccgcccaggtggcgcaccaagaggccgaatatttggccaagaattttgacaaaatggctcaaatcccaaatttccagaagaatctgtcctcacggaaggataaaattgatctcttgttcgaggagaacaactttaagcctttcaagtacaacgatttaggtgccttagcctacctgggcagcgaaagagccattgccaccatacgttccggtaagagaacattttacaccggtggtggcctgatgaccttctacttatggagaattttgtacttgagcatgatcctaagcgcaagatcgagattaaaggtgtttttcgactggattaaattagcatttttcaaaagagacttttttaaaggattatag

SEQ ID NO: 875 - DNA, 1542 bp, Artificial Sequence
  source: /note="Description of Artificial Sequence: Synthetic polynucleotide"
atgctatcgaagaatttgtatagtaacaagaggttgctgaccagcaccaatacgctcgtgcgcttcgctagcaccagatccaccggggtggaaaactccggggcaggccccacaagctttaagaccatgaaaatcatcgacccccagcacagcgacaaaccaaacgtgctgatactgggttctggctggggagccatttcgtttttaaagcacattgacaccaagaagtacaacgtttccatcgtgtctcccagaagctatttcatctttacgcctttgttaccttctgcaccagtggggaccgtagacgaaaagtccatcattgagcccatcgttaatttcgctctcaagaaaaaggggaacgttacctactatgaggccgaagccacctctatcaatcccgaccggaataccgttaccataaaatcactgtctgccgtgagccagctgtaccaacctgagaaccatctaggcctgcatcaagcagaacccgctgagattaagtacgattatttaatcagcgctgtaggtgccgagcctaacacatttggaatccctggggtgaccgattacggccacttcctgaaggaaatccccaactctttggaaatcagacggactttcgccgccaatctggagaaggctaacctgttgccaaagggcgatcccgaaagaagaagactactgtccatcgtcgtggtgggcggtgggcctactggcgtagaagccgctggtgagctacaggactatgttcaccaggacctgagaaagtttctccctgccttggccgaagaagtccagattcacttggtggaagctctgcccatcgttttgaatatgtttgagaaaaagctttcaagctacgcgcagtcacatttagaaaacacttcgatcaaagtgcatctgagaaccgctgtcgccaaggttgaagagaagcaattgctggccaagacgaaacacgaggacggtaaaataaccgaagaaactattccatacggtactttgatttgggccacgggtaacaaggcaagaccggtaatcacagaccttttcaagaagattcctgagcagaactcgtccaagcggggactggcagtgaacgactttttgcaagtcaaaggcagcaacaacattttcgccattggcgacaatgcatttgccgggttgccaccaaccgcccaagtggcgcaccaggaggccgaatacttggccaagaactttgacaagatggctcaaatccccaatttccaaaagaatctgtcttcaagaaaggataagattgatctcttgttcgaggaaaacaactttaaacctttcaaatacaacgatttaggcgccttagcatacctgggaagcgaaagggccattgcaaccatacgttccggtaagagaaccttctacaccggtggaggcttaatgaccttctacctgtggagaattatctacatgagcatgattctgtctgcaagatcgagattaaaggtctttttcgactggattaaattagccttcttcaaaagagacttcttcaaaggattatag

SEQ ID NO: 876 - DNA, 1542 bp, Artificial Sequence
  source: /note="Description of Artificial Sequence: Synthetic polynucleotide"
atgctgtcgaagaatttgtatagtaacaagcggctgctcacctcgacgaatacgctagtccgcttcgcttccaccagatccaccggggtggaaaactccggagcaggtcctaccagctttaagaccatgaaaatcattgaccctcagcacagcgacaaaccaaacgtgctgatactgggttcgggctggggagctattagctttttaaagcacatcgacaccaagaagtacaacgttagcatcgtgagccctagaagctatttcctgtacacgcctttgctgcccagcgcaccagttgggacagtagacgagaagtccatcatcgagcccatcgttaacttcgctctcaagaaaaagggcaacgttacctactacgaggccgaagccacctctatcaatcccgacaggaacaccgttaccatcaagtcattatctgccgttagccagctataccaacctgaaaaccatctgggcctgcaccaagccgaacctgccgaaattaagtacgactacttaatcagtgctgtaggtgccgagcctaacacatttggtattcctggcgtcactgattacggtcatttcctgaaagagattcccaactctttggaaatacggagaacttttgccgccaatctggagaaggctaacctgctgccaaagggtgaccccgaaagaagaaggctactgtccatcgtcgtcgtgggtggtggccctactggtgtagaggccgctggtgaactacaggattatgttcaccaggacctgagaaagttcctccccgcattggccgaggaaatccaaattcacctggtcgaagccctgcccatcgttttgaatatgtttgagaaaaagcttagctcatacgcgcagtcacatttagaaaacacttccatcaaagtgcatctgagaacggctgtcgccaaggttgaagaaaagcaactgttggcaaagacgaaacacgaagacggtaaaataaccgaagaaactattccctacggtactttgatttgggccacgggtaacaaggccagaccggtgatcacagaccttttcaagaagatccctgagcaaaacagcagcaagagaggcttggcagtgaacgacttcctgcaagtcaaaggcagcaacaacattttcgccattggcgacaatgcatttgctgggttgcctcctaccgcccaggtggcgcaccaagaggccgaatacctggccaagaatttcgataaaatggcccaaataccaaatttccagaagaatctatcttcaagaaaggataagattgatctgttgttcgaggagaacaactttaagcctttcaaatacaacgatttaggtgccttagcatacctgggatccgaaagggccattgcaaccatacgttccggcaagcggaccttttacaccggtggtggcttaatgaccttctacttatggagaatcatctacctgtccatgatcctatctgcaagatcgagactgaaggtctttttcgactggattaaactggcctttttcaagagagactttttcaagggcttatag

SEQ ID NO: 877 - DNA, 1542 bp, Artificial Sequence
  source: /note="Description of Artificial Sequence: Synthetic polynucleotide"
atgctaagcaagaatctgtatagcaacaagaggttgctcacctcgacgaatacgctcgtcagattcgcctccaccagatccacaggcgtcgaaaactccggagctggtcctacaagcttcaagaccatgaaaatcattgaccctcagcacagcgacaaaccaaacgtgctgatactgggttcggggtggggagccattagctttttaaagcacattgacaccaagaagtacaacgtctccatcgtgtctcctagaagctatttcatctacacgcctttgttaccctctgcaccagttggaacagtggacgagaagtcaattattgagcccatcgttaattttgccctcaagaaaaaggggaacgttacctactatgaggcagaggccacctctatcaaccccgaccggaataccgttaccataaagtcactgtctgccgtgtcccagctgtaccagcctgaaaaccatctaggcctgcatcaagcagagcccgccgagattaagtacgattatttaatcagtgctgtaggtgccgagcctaacacatttggtatccctggggtcactgattacggtcacttcctgaaggagatccccaacagcctggaaataagaagaactttcgccgccaatctagaaaaggctaacttattgcctaagggcgatcccgaaagaagaagactgctgtccatcgtggtcgttggtggtgggcctacaggtgtggaggctgctggtgagctacaggactacgtgcaccaggacctgagaaagtttctgcctgcattggccgaagaaatccaaattcacttggtcgaagccctgcccatcgttttgaatatgtttgagaagaagctttcatcatacgcccaaagccatttagaaaacacttccatcaaagtacatctgagaacggctgtggccaaagttgaagagaagcaattgttggcaaagacgaaacacgaggacggcaaaattaccgaagaaactattccatacggtaccttgatttgggccacgggtaacaaggcaagaccggtgatcacagacctgttcaagaaaattcctgagcaaaactcgtccaagagaggattggcagtgaatgacttcttgcaagtcaaaggcagcaacaacattttcgccatcggtgacaacgcatttgctgggttgcctccaacagcccaagtggcgcaccaagaagccgaatacttggccaagaatttcgataagatggctcaaatccccaatttccagaagaatctatcttcccggaaggataaaattgacctcttgttcgaggagaacaactttaaacctttcaaatacaacgacctgggtgccttagcctacctgggatccgaaagggccattgcaaccatccgttccggtaagagaacattttacaccggcggtggcctgatgaccttctacctgtggagaattctgtacttgtccatgatcctatctgcaagatcgagattaaaggtgttcttcgactggattaaattagcattcttcaaaagagactttttcaagggattatag

SEQ ID NO: 878 - DNA, 1542 bp, Artificial Sequence
  source: /note="Description of Artificial Sequence: Synthetic polynucleotide"
atgctaagcaagaacttgtatagtaacaagaggttgctgaccagcaccaatacgctcgtgagattcgctagcaccagatccacaggcgtcgaaaactccggagcaggtcccacctctttcaagaccatgaaaatcattgaccctcagcacagcgacaagcccaacgtgctgatactgggttctggctggggcgctatctcgtttttaaagcacatcgacaccaagaagtacaacgtttccatcatctctcccagaagctatttcatctacacgcctttgttaccctctgcaccagttgggacagtagacgagaagtcaatcattgagcccatcgttaatttcgccctcaagaaaaagggcaacgttacctactacgaggcagaggccacctctatcaatcccgacaggaataccgtgaccataaagtcactgtctgccgttagccagctataccaacctgagaaccatctaggcctgcatcaagccgaacctgctgaaattaagtacgattatctgatcagcgctgtgggtgcggagcctaacacatttggtattcctggggtgactgattacggtcatttcctgaaggagattcccaactctttggaaatccggcggaccttcgccgccaatctggagaaggctaacctgttgcctaagggtgatcccgaacggagaaggctactgtccatcgtcgtggttggtggtgggcccactggtgtagaggccgctggtgaactacaggactatgtgcaccaggacctgagaaagtttctccccgcattggccgaagaagtccaaattcacttggtcgaagctctgcccatcgttttgaatatgtttgagaaaaagctttcatcatacgcccaaagccatttagaaaacacttcgatcaaagtacatctgagaaccgctgtggccaaggttgaagaaaagcaattgctggcaaagacgaaacacgaagacggcaaaattaccgaagaaactatcccatacggtactttgatttgggccacgggtaacaaggccagacccgtaatcacagaccttttcaagaaaatccctgagcaaaacagcagcaagagaggactggcagtgaatgactttctgcaagtgaaaggcagcaacaacattttcgccattggtgacaacgcctttgctgggctgccaccaacagcccaagtggcccaccaagaggccgaatatttggccaagaactttgataaaatggctcagataccaaatttccaaaagaacctgtcctcccggaaggataaaattgatctcttgttcgaggagaacaacttcaaacccttcaagtacaacgatttaggtgccctggcatacctgggctccgaaagggccattgcaaccatccgttccggcaagagaacattctacaccggtggtggcttaatgaccttctacttatggagaattatctacatgagcatgattctgtctgcacgcagcagattaaaggtctttttcgactggatcaaattagcatttttcaaaagagacttttttaagggattatag

SEQ ID NO: 879 - DNA, 1542 bp, Artificial Sequence
  source: /note="Description of Artificial Sequence: Synthetic polynucleotide"
atgctgtcgaagaatttgtatagtaacaagaggttgctcacctcgaccaataccctagtccgcttcgcttccaccagatccacaggcgtcgaaaacagcggagcaggtcctacatcttttaagaccatgaaaatcattgaccctcagcacagcgacaaaccaaacgtgctgatactgggttctggctggggagctatttcgtttctgaagcacatcgacaccaagaagtacaacgttagcatcgtgtctcccagaagctacttcatcttcacgcccctgttacctagcgccccagtggggacagtagacgaaaagtcaattattgagcccatcgttaatttcgctctcaagaaaaaggggaacgtcacctactatgaggccgaagccacctctatcaatcccgacaggaataccgtgaccatcaagtcattatctgccgtgagccagctgtaccagcccgaaaaccacctagggctgcaccaagcagaacctgctgaaattaagtacgattacttaatcagtgctgtaggtgcggaacctaacacatttggtatccctggggtcactgactacggtcatttcctgaaggaaatccccaactctctggaaatacggagaactttcgccgccaatctagagaaggctaacttattgcctaagggcgatcccgaacggagaagactgctgtccatcgtggtggttggtggtgggcctactggtgtagaagccgctggtgaactgcaggattatgtgcaccaggacctgagaaagtttctccctgcattggccgaagaagtccaaattcacttggtggaagctctgcccatcgttctgaatatgttcgagaagaagctttcatcatacgcccaatcacatctggaaaacacctccatcaaagtacatctgagaaccgccgtcgccaaggttgaagagaagcaattgctggccaagacgaaacacgaggacggtaagataaccgaagaaaccattccatacggtactctgatttgggccacgggtaacaaggcaagacccgtaatcacagacctgttcaagaagattcctgagcaaaactcgagcaagagaggattggcagtgaatgactttttgcaggtgaaaggcagcaacaacattttcgccattggtgacaatgcatttgccggcttgccacctaccgcccaagtggcccaccaagaggccgaatatctggccaagaatttcgacaaaatggctcaaatccccaatttccaaaagaatctatcttcacggaaggataaaatcgatctcttgttcgaggagaacaactttaagcctttcaagtacaacgacttaggcgccttagcatacctgggatccgaaagggccattgcaaccatccgttccggtaagagaacattttacaccggtggaggcttaatgaccttctacttatggcggatcatctacatgtccatgattctatctgcaagaagcagactgaaggtctttttcgactggatcaaactggcatttttcaagagagacttcttcaagggcttatag

SEQ ID NO: 880 - DNA, 1542 bp, Artificial Sequence
  source: /note="Description of Artificial Sequence: Synthetic polynucleotide"
atgctatcgaagaatttgtatagtaacaagaggttgctgacctcgacgaataccctagtccgcttcgcttccaccagatccacaggggtggaaaacagcggggcaggtcctacatctttcaagaccatgaaaatcattgaccctcagcacagcgacaagccaaacgtgctgatactgggttcggggtggggagctattagctttctgaagcacattgacaccaagaagtacaacgtctccatcgtgtctcctagaagctatttcatctacacgcctttgctgccttctgcaccagttgggaccgtggacgaaaagtcaatcattgagcccatcgttaacttcgctctcaagaaaaaggggaacgtcacctactatgaggcagaagccacctctatcaatcccgacaggaataccgttaccataaaaagcttatctgccgtgagccagctataccagcctgaaaaccatctagggctgcatcaagcagagcctgctgaaattaagtacgactacttaatcagtgccgtgggtgcggaacctaacacatttggtatccctggcgtgaccgattacggccacttcctgaaggagatccccaacagcttggaaatcagaagaacctttgccgccaatctagagaaggctaacctgctgccaaagggcgaccccgagcggagaagactgctgagcattgtggtggtgggtggaggccccactggtgtagaggccgctggtgagctacaggattatgttcaccaggacctgagaaagtttctccctgcattggccgaagaagtccagattcacctggtcgaagccctgcccatcgttttgaacatgttcgagaagaagctttcatcatacgcgcaatcacatttagaaaacacttcgatcaaggtacatctgagaacggccgtggccaaagttgaagagaagcagttgttggccaagacgaaacacgaggacggtaaaataaccgaagaaactattccatacggcactttgatttgggccaccggtaacaaggcaagaccggtaatcacagaccttttcaagaagattcctgagcaaaactcgtccaagagaggattggcagtgaatgacttcttgcaggtcaaaggcagcaacaacatcttcgccatcggtgacaatgcatttgctgggttgcctccaacagcccaagtggcccaccaagaggccgagtacctggccaagaactttgacaaaatggctcaaataccaaatttccaaaagaatctgtcctccagaaaggataaaatcgatctcttgttcgaggagaacaacttcaagcccttcaaatacaacgatttaggtgccttagcctacctgggctccgaaagggccattgcaaccatacgtagcggtaagcggacattttacaccggcggtggcctgatgaccttctacttatggagaatcttgtacatgagcatgattctaagcgcaagatcgagattaaaggtgtttttcgactggattaaattagcctttttcaaaagagactttttcaaaggattatga

SEQ ID NO: 881 - DNA, 1542 bp, Artificial Sequence
  source: /note="Description of Artificial Sequence: Synthetic polynucleotide"
atgctatcgaagaatctgtatagtaacaagaggttgctgacctcgacgaacacgctagtcagattcgcctccaccagatccacaggggtggaaaacagcggagctggtcctacatcttttaagaccatgaaaatcatcgacccccagcacagcgacaaacccaacgtgctgatactgggttcgggctggggcgccattagctttttaaagcacattgacaccaagaagtacaacgtttccatcatcagccctagaagctatttcttatacacgcccctgctgccttctgccccagtgggaacagtagacgaaaagtcaattattgagcccatcgttaactttgctctcaagaaaaagggcaacgttacctactacgaggcagaagccacctctatcaatcccgacaggaacaccgttaccataaaatcactgtctgccgttagccagctataccaacccgaaaaccacctagggctgcaccaagcagagcccgccgaaattaagtacgattatttaatcagtgccgtaggtgcggagcctaacacatttggtattcctggggtcactgattacggtcatttcctgaaagaaattcccaactctctggaaataagacggacctttgccgccaacctagaaaaggccaacttattgccaaagggtgatcccgaaagaagaagactactgtccatcgtcgtggttggtggaggccctactggcgtggaggccgctggtgagctacaggactatgttcaccaggacctgagaaagtttctgcctgcattggccgaagaaatccaaattcacttggtcgaagccctgcccatcgttttgaatatgtttgagaagaagcttagcagctacgcgcaatcacatttagaaaacacctcgatcaaagtgcacctgagaacggccgtcgccaaagttgaagaaaagcagttgctggcaaagaccaagcacgaagacggtaaaataaccgaagaaactattccatacggcaccttgatttgggccacgggcaacaaggcaagacccgtaatcacagaccttttcaagaagattcccgagcagaacagctccaagagaggattggcagtgaatgactttttgcaagtgaaaggcagcaacaacatcttcgccatcggtgacaatgcctttgctgggttgcctcctaccgcccaagtggcgcaccaagaggccgagtacttggccaagaacttcgacaagatggctcaaatcccaaatttccaaaagaacctatcttcaagaaaggataagattgatctcttgttcgaggaaaacaactttaaacccttcaaatacaacgatttaggcgccttagcatacctgggatccgaaagggccattgccaccatccgtagcggtaagagaaccttttacaccggtggtggcttaatgaccttctacctgtggagaatcatctacatgtccatgatcctgtctgccagatcgagactgaaggtctttttcgactggattaagttagcatttttcaagagggacttttttaaaggcttatag

SEQ ID NO: 882 - DNA, 1542 bp, Artificial Sequence
  source: /note="Description of Artificial Sequence: Synthetic polynucleotide"
atgctatcgaagaatttgtacagcaacaagaggctgctcacctcgacgaatacgctcgtcagattcgctagcaccagatccacaggggtggaaaactccggagcaggtcctacctcttttaagaccatgaaggtcattgaccctcagcacagcgacaaacccaacgtgctgatcctgggctcggggtggggcgccatctcgtttttaaagcacattgacaccaagaagtacaacgtctccatcgtgagccccagaagctatttcatctacacccctctgttaccttctgccccagtgggaacagtagacgaaaagtccattattgagcccatcgttaattttgctctcaagaaaaaggggaacgtcacctactatgaggccgaagccaccagcatcaatcccgacaggaataccgttaccataaaatcattatctgccgtttcccagctgtaccaacctgaaaaccatctaggcctgcatcaagccgaacccgccgaaattaagtacgactatttaatcagtgctgtaggtgccgaacctaacacatttggtatccctggcgtcaccgactacggccacttcctgaaggaaatccccaacagcttggaaatacggagaaccttcgccgccaatctagaaaaggccaacctgttgccaaagggcgatcccgagagaagaaggctgctgagcattgtggtcgttggtggtgggcctactggtgtggaagccgctggcgaactacaggattatgttcaccaggacctgagaaagtttctccctgcattggccgaagaaatccagattcacctggtcgaagctctgcccatcgttttgaatatgtttgagaaaaagctttcatcatacgcgcaatcacatctggaaaacacttcgatcaaagtgcacctgagaacggctgtggccaaagttgaagagaagcaattgttggcaaagaccaaacacgaggacggtaagataaccgaagaaactattccatacggtactctgatttgggccaccggcaacaaggcaagaccggtaatcacagaccttttcaagaaaattcccgagcaaaactcgtccaagcggggattggcagtgaacgactttttgcaagtcaaaggcagcaacaacatcttcgccattggtgacaatgcatttgctgggttgcctcctaccgcccaggtggcccaccaagaagccgagtatttggccaagaacttcgataaaatggctcaaataccaaatttccaaaagaatctatcttcaagaaaggataaaattgatctcttgttcgaggaaaacaactttaagcctttcaaatacaacgacttaggtgccctggcatacctgggatccgaaagggccattgcaaccatacgttccggcaagagaacattttacaccggcggtggcctgatgaccttctacttatggagaattatctacttgtccatgattctatctgcccgcagcagactgaaggtctttttcgactggattaaattagcattcttcaaaagagacttcttcaaaggcctgtag

SEQ ID NO: 883 - DNA, 1542 bp, Artificial Sequence
  source: /note="Description of Artificial Sequence: Synthetic polynucleotide"
atgctaagcaagaatctgtatagtaacaagaggctgctcaccagcacgaatacgctagtcagattcgctagcaccagatccacaggcgtggaaaacagcggagcaggtcctacatctttcaagaccatgaaagtcatcgaccctcagcacagcgacaagcccaacgtgctgatactgggttcggggtggggagccatttcgtttttaaagcacattgacaccaagaagtacaacgtttccatcgtgtctcctagaagctatttcatctacacgcctctgttacccagcgcaccagtggggacagtggacgagaagtcaattattgagcccatcgttaatttcgctctcaagaaaaaggggaacgttacctactatgaggcagaagccacctctatcaatcccgacaggaataccgttaccataaagtcattatctgccgttagccagctataccagcctgaaaaccatctggggctgcaccaagcagagcctgctgagattaagtacgactatttaatcagcgccgtaggcgcggaacccaacacatttggtatccccggcgtcactgactacggtcacttcctgaaggaaattcccaacagcctggaaatccggagaacttttgccgccaacctggaaaaggctaacctgttgcctaagggcgatcccgagcggagaagactactgtccatcgtggtggtgggcggtggccctactggtgtggaggccgctggcgagctacaggattatgtgcaccaggacctgagaaagtttctccctgccttggccgaagaaatccaaattcacttggtcgaagctctgcccatcgttttgaatatgtttgagaaaaagctgtcatcatacgcgcagagccacttagaaaacacttcgatcaaagtacatctgagaacggctgtggccaaagttgaagaaaagcaattgttggcaaagacgaaacacgaagacggtaagataaccgaagaaactattccctacggcaccctgatttgggccaccggcaacaaggccagaccggtaatcacagaccttttcaagaaaattcctgagcaaaacagctccaagagaggattggcagtgaacgacttcttgcaagtcaaaggcagcaacaacattttcgccattggtgacaacgcatttgctgggttgccacctaccgcccaagtggcccaccaagaggccgaatatttggccaagaactttgacaaaatggctcaaataccaaatttccaaaagaatctatcctccagaaaggataaaatcgatctgctgttcgaggagaacaactttaagcctttcaagtacaacgacctgggtgccttagcatacctgggatccgaaagggccattgcaaccataagatccggcaagagaacattttacaccggtggtggcttaatgaccttctacttatggcggattatctacctgtccatgattctaagcgcaagaagcagattaaaggtgttcttcgactggattaaattagcatttttcaagagggacttttttaaaggattatag

SEQ ID NO: 884 - DNA, 1542 bp, Artificial Sequence
  source: /note="Description of Artificial Sequence: Synthetic polynucleotide"
atgctatcgaagaacctgtacagtaacaagaggttgctcacctcgacgaatacgctagtgcgcttcgcttccaccagatccacaggcgtggaaaacagcggagcaggccccacatcttttaagaccatgaaaatcattgacccccagcacagcgacaaaccaaacgtgctgatactgggttcggggtggggcgctattagctttttaaagcacatcgacaccaagaagtacaacgtttccatcatctctcctagaagctatttcatctacacgcctttgctgccctctgcaccagttgggacagtagacgaaaagtcaatcattgagcccatcgtgaacttcgctctcaagaaaaagggcaacgtcacctactatgaggccgaagccacctctatcaaccccgacaggaacaccgttaccatcaaatcactgagcgccgtgagccagctataccaacctgagaaccatctggggctgcatcaggcagaacctgctgaaattaagtacgattatttaatcagtgctgtaggcgcggaacctaacacatttggtatccctggcgtcaccgattacggccacttcctgaaggaaattcccaacagcttggaaatcagaagaacttttgccgccaatctggagaaggctaacctgttgccaaagggcgatcccgaaagaagaagactgctgtccatcgtcgtggtgggtggaggccctactggtgtagaagctgctggtgaactgcaggattatgttcaccaggacctgagaaagtttctccctgccttggccgaagaaatccaaattcacttggtcgaagctctgcccatcgttttgaatatgtttgagaaaaagctttcatcatacgcgcagtcacatctggaaaacacttcgatcaaagtacatctgagaacggccgtcgccaaggttgaagaaaagcagttgttggcaaagacgaaacacgaagacggcaagataaccgaggaaactattccatacggcactctgatttgggccacgggcaacaaggcaagaccggtaatcacagaccttttcaagaaaattcctgagcaaaacagcagcaagcggggattggccgtgaatgacttcttgcaagtgaaaggcagcaacaacattttcgccatcggtgacaacgcatttgccggcttgcctccaaccgcccaagtggcccaccaagaggccgaatatttggccaagaactttgataaaatggcccagatacccaatttccagaagaacctatcttccagaaaggataagattgatctcttgttcgaggagaacaactttaaacccttcaaatacaacgatctgggtgccctggcatacctgggatccgaaagagccattgccaccatccgttccggtaagcggaccttctacaccggtggtggcctgatgaccttctacttatggagaattatctacttgagcatgattctatctgccagaagcagattaaaggtcttcttcgactggattaaattagcattcttcaaaagagacttctttaagggactgtag

SEQ ID NO: 885 - DNA, 1542 bp, Artificial Sequence
  source: /note="Description of Artificial Sequence: Synthetic polynucleotide"
atgctaagcaagaacttgtacagcaacaagcggctgctgaccagcaccaataccctcgtgcgcttcgctagcaccagatccacaggcgtggaaaactccggggctggtcccaccagcttcaagaccatgaaggtcatcgacccccagcacagcgacaaaccaaacgtgctgatactgggctcgggctggggagccattagctttctgaagcacatcgacaccaagaagtacaacgtttccatcatcagccccagaagctacttcctgttcacgcccttgctgccctctgcacctgttgggaccgtagacgagaagtccattattgagcccatcgttaacttcgccctgaagaaaaagggcaacgtcacctactatgaggccgaagccaccagcatcaatcccgacaggaacaccgttaccataaagagcctgagcgccgtgtcccagctgtaccagcctgaaaaccacctggggctgcatcaagccgagcccgccgagattaagtacgactacctgatcagcgccgtgggtgcggaacccaacacctttggaattcccggggtcaccgactacggtcacttcctgaaagagattcccaactctctggaaatccggcggacctttgccgccaacctggagaaggctaacctgctgccaaagggtgaccccgagcggagaaggctgctgtccattgtcgtggttggtggagggcccactggtgtagaagccgctggcgagctgcaggactatgtgcaccaggacctgcggaagttcctgcccgcactggccgaggaagtgcagattcacttggtcgaagccctgcccatcgtgttgaatatgttcgagaagaagctgtcatcatacgcgcagagccatctggaaaacacctccatcaaagtgcatctgagaacggccgtggccaaagttgaagaaaagcagctgctggccaagacgaaacacgaggacggcaagattaccgaggaaactatcccctacggtaccctgatttgggccaccggtaacaaggcaagaccggtgatcacagaccttttcaagaaaattcctgagcagaacagcagcaagagaggcctggccgtgaatgacttcttgcaggtgaaaggcagcaacaacattttcgccattggcgacaatgcctttgccggcttgccacctacagcccaggtggcgcaccaggaggccgagtacctggccaagaattttgacaagatggctcagatcccaaatttccagaagaacctatcctcaagaaaggataagattgatctcctgttcgaggagaacaacttcaaacccttcaagtacaacgatctgggtgccctggcctacctgggcagcgaaagggccattgccaccatcagatccggcaagcggacattctacaccggtggaggcttaatgaccttctacctgtggagaattttgtacctgagcatgatcctaagcgcacgcagcagactgaaggtgtttttcgactggattaagctggccttcttcaaaagggactttttcaagggcctgtag

SEQ ID NO: 886 - DNA, 1542 bp, Artificial Sequence
  source: /note="Description of Artificial Sequence: Synthetic polynucleotide"
atgctatcgaagaacctgtatagtaacaagcggctgctgacctcgaccaataccctcgtgcgcttcgctagcaccagatccaccggcgtcgaaaactccggggctggccccaccagcttcaagaccatgaaagtcatcgacccccagcacagcgacaagccaaacgtgctgatactgggttcgggctggggcgctatcagctttctgaagcacattgacaccaagaagtacaacgtctccatcatcagccccagaagctacttcttatttacgcctctgttaccctctgcaccagtgggaacagtagacgagaagtcaattatcgagcccatcgtgaatttcgctctgaagaaaaagggcaacgtcacctactacgaggccgaggccacctctatcaaccccgacaggaacaccgttaccatcaagtcactgtctgccgttagccagctataccaacctgagaaccacctggggctgcaccaggccgaacctgctgagattaagtacgattatttaatcagtgctgtgggcgccgagcccaacacatttggaatccccggcgtcaccgattacggccacttcctgaaagaaatccccaacagcttggaaatccggagaaccttcgccgccaacctggaaaaggctaacttactgccaaagggtgaccccgaaagaagaaggctgctgtccatcgtcgtcgtgggtggaggccctactggtgtggaagccgctggcgagctgcaggattatgtgcaccaggacctgcggaagttcctgcctgccctggccgaagaagtgcagattcacctggtcgaagctctgcccatcgttctgaatatgtttgagaagaagctgtcaagctacgcgcaatcacacctggaaaacacctccatcaaagtacatctgagaacggccgtggccaaggttgaagagaagcaactgttggccaagaccaagcacgaggacggcaagattaccgaagaaactatcccctacggcactctgatttgggccaccggtaacaaggccagacccgtgatcaccgacctgttcaagaagatccccgagcaaaacagctccaagcggggcttggccgtgaatgacttcttgcaagtcaaaggcagcaacaacattttcgccatcggcgacaatgcatttgccggcctgccacctacagcccaggtggcgcaccaggaagccgaatatctggccaagaattttgacaaaatggcccagatcccaaatttccagaagaatctgtcctcccggaaggataagattgatctgttgttcgaggaaaacaacttcaaacccttcaagtacaacgacttaggcgccctggcctacctgggcagcgaaagagccattgccaccatcagaagcggcaagcggacattttacaccggtggaggcctgatgaccttctacctgtggagaatcttgtacttgagcatgatcctatctgcacgcagcagactgaaggtctttttcgactggatcaaactggccttcttcaagagagacttctttaagggcctgtag

SEQ ID NO: 887 - DNA, 1542 bp, Artificial Sequence
  source: /note="Description of Artificial Sequence: Synthetic polynucleotide"
atgctaagcaagaacctgtacagcaacaagaggctgctcacctcgacgaacaccctagtccgcttcgccagcaccagatccaccggcgtcgaaaacagcggagcaggtcccacaagctttaagaccatgaaggtcatcgacccccagcacagcgacaaaccaaacgtgctgatcctgggctctgggtggggagccatttcgtttttaaagcacatcgacaccaagaagtacaacgttagcatcatcagccccagaagctatttcctgttcacccctctgttacctagcgcacctgttgggaccgtggacgagaagtccattattgagcccatcgttaatttcgccctcaagaaaaaggggaacgttacctactatgaggccgaagccaccagcatcaatcccgaccggaataccgttaccataaagagcctgagcgccgtgtcccagctgtaccagcctgagaaccacctggggctgcaccaagccgagcccgctgagattaagtacgactacctgatcagtgccgtaggcgcggaacctaacacatttggtattcccggcgtgactgattacggccatttcctgaaggaaatccccaacagcctggaaatccggcggacctttgccgccaacctagaaaaggctaacttactgcctaagggcgaccccgaacggagaagactgctgagcattgtggtcgtgggcggagggcccacaggcgtggaagctgctggtgagctgcaggactatgttcaccaggacctgagaaagtttctccccgccctggccgaagaagtccagattcacctggtggaagccctgcccatcgtgctgaacatgttcgagaaaaagctgtcaagctacgcccaaagccatctggaaaacacctccatcaaggtgcacctgagaaccgccgtggccaaggtggaagaaaagcaactgttggccaagaccaagcacgaggacggcaagataaccgaagaaaccatcccatacggcaccctgatttgggccaccggcaacaaggcaagacccgtaatcaccgacctgttcaagaaaatccctgagcagaactcgtccaagcggggcttggccgtgaacgacttcctgcaggtgaaaggcagcaacaacatcttcgccatcggcgacaatgcctttgccggcctgcctcctacagcccaagtggcgcaccaagaggccgaatatttggccaagaacttcgacaagatggcccagataccaaatttccagaagaatctatcctcacggaaggataagattgacctcctgttcgaggaaaacaactttaaacctttcaaatacaacgatctgggtgccttagcctacctgggcagcgaaagagccattgcaaccatccgttccggtaagcggacattctacaccggtggaggcctgatgaccttctacttatggcggatcttgtacctgagcatgattctgtctgcacgcagcagattaaaggtgtttttcgactggatcaagttagccttcttcaagagggactttttcaaaggcctgtag

SEQ ID NO: 888 - DNA, 1542 bp, Artificial Sequence
  source: /note="Description of Artificial Sequence: Synthetic polynucleotide"
atgctatcgaagaatctgtacagcaacaagcggttgctcaccagcaccaacaccctcgtccgcttcgctagcaccagatccacaggcgtcgaaaactccggggcaggtcctaccagctttaagaccatgaaggtcatcgacccccagcacagcgacaaacccaacgtgctgatcctgggctctggctggggcgctatcagctttctgaagcacattgacaccaagaagtacaacgttagcatcatcagccccagaagctacttcttatttacgcccctgttaccctctgcccctgttgggacagtggacgagaagtcaatcatcgagcccatcgttaactttgccctgaagaaaaagggcaacgttacctactacgaggccgaggccacctctatcaatcccgacaggaataccgtgaccatcaagagcctgagcgccgtttcccagctgtaccagcctgagaaccacctggggctgcaccaggcagaacccgctgaaattaagtacgattatctgatcagcgccgtaggtgccgagcccaacacctttggaattcccggggtgaccgactacggtcatttcctgaaagaaattcccaacagcttggaaataagacggaccttcgccgccaacctggagaaggccaacttattgcctaagggtgatcccgagcggagaaggctgctgagcatcgtggtcgtgggtggtggccccactggtgtggaagctgctggcgaactgcaggactacgttcaccaggacctgcggaagtttctgcccgccctggccgaagaagtgcaaattcacctggtggaagccctgcccatcgtgttgaacatgtttgagaaaaagcttagctcatacgcgcagagccatttagaaaacacctccatcaaggtacacctgagaaccgctgtcgccaaagtggaagaaaagcagttgctggccaagaccaagcacgaggacggtaagataaccgaagaaactattccctacggcactttgatttgggccaccggtaacaaggccagaccggtgatcacagacctgttcaagaagattcctgagcagaacagcagcaagcggggcttggccgtgaatgacttcctgcaagtcaaaggcagcaacaacatcttcgccatcggcgacaacgcatttgctgggctgccacctaccgcccaagtggcccaccaggaagccgaatacctggccaagaatttcgataaaatggcccaaatccccaatttccagaagaacctgtcttccagaaaggataagatcgacctgctgttcgaggaaaacaacttcaagcccttcaaatacaacgatttaggtgccctggcctacctgggcagcgaaagagccattgccaccatacgtagcggtaagcggaccttttacaccggtggaggcctgatgaccttctacctgtggagaatcttgtacctgagcatgatcctgtctgcccgcagcagactgaaggtctttttcgactggattaaattagcattcttcaaaagggactttttcaaaggcctgtga

SEQ ID NO: 889 - DNA, 1542 bp, Artificial Sequence
  source: /note="Description of Artificial Sequence: Synthetic polynucleotide"
atgctgagcaagaacttgtacagcaacaagaggttgctgacctcgacgaacacgctagtgagattcgccagcaccagatccacaggcgtcgaaaactccggggctggccccaccagctttaagaccatgaaagtcattgacccccagcacagcgacaaacccaacgtgctgatcctgggttctgggtggggcgctatctcgtttctgaagcacattgacaccaagaagtacaacgtcagcatcatcagccccagaagctatttcttattcacccccctgctgcccagcgcccctgtgggaacagtggacgagaagtccatcattgagcccatcgtgaatttcgccctcaagaaaaaggggaacgtcacctactacgaggccgaagccaccagcatcaatcccgaccggaacaccgttaccatcaagagcttatctgccgtgagccagctataccaacccgagaaccatctggggctgcatcaggccgagcccgccgagattaagtacgactatttaatcagcgccgtgggtgccgagcctaacacctttggaatccccggcgtgaccgactacggtcatttcctgaaagaaatccccaactctctggaaatccggcggacttttgccgccaacctagaaaaggctaacctgttgcctaagggcgaccccgagagaagaagactgctgagcatcgtggtcgtgggcggtggccctacaggtgtggaggctgctggcgaactgcaggactacgttcaccaggacctgagaaagttcctccctgcactggccgaagaagtgcaaattcacctggtcgaagccctgcccatcgtgttgaatatgtttgagaagaagctgagcagctacgcccagagccatttagaaaacacttcgatcaaggtacatctgagaacggccgtggccaaggtggaagagaagcagctgctggccaagacgaaacacgaggacggtaaaataaccgaggaaactatcccctacggcaccttgatttgggccaccggtaacaaggccagaccggtgatcacagacctgttcaagaagatccccgagcagaacagcagcaagagaggcctggccgtgaatgacttcttgcaggtgaaaggcagcaacaacattttcgccatcggcgacaacgcatttgctgggttgcctcctacagcccaggtggcgcaccaggaggccgaatacttggccaagaattttgacaaaatggctcaaatccccaatttccagaagaatctatcctcccggaaggataagattgatctcttgttcgaggaaaacaacttcaagcccttcaagtacaacgatttaggtgccttagcatacctgggaagcgaaagagccattgccaccataagatccggtaagcggaccttctacaccggcggaggcctgatgaccttctacctgtggcggatcttgtacctgtccatgattctgtctgccagaagcagactgaaggtgtttttcgactggatcaaactggcctttttcaaaagggacttttttaagggcctgtag

SEQ ID NO: 890 - DNA, 1542 bp, Artificial Sequence
  source: /note="Description of Artificial Sequence: Synthetic polynucleotide"
atgctgtcgaagaacttgtatagtaacaagcggctgctcacctcgacgaacacgctcgtcagattcgcctccaccagatccaccggcgtggaaaacagcggggctggtcctacctctttcaagaccatgaaggtcatcgacccccagcacagcgacaaacccaacgtgctgatcctgggctcgggctggggagctatctcgtttttaaagcacatcgacaccaagaagtacaacgttagcatcatctctcccagaagctacttcttattcacgcccctgttacccagcgccccagtggggaccgtagacgaaaagtccatcattgagcccatcgtgaatttcgccctgaagaaaaaggggaacgttacctactacgaggccgaggccaccagcatcaatcccgaccggaataccgtgaccataaagtcactgtctgccgtgagccagctataccaacctgagaaccacctaggcctgcatcaggcagagcccgctgaaattaagtacgactacctgatcagcgccgtaggtgccgaacccaacacctttggtatccccggcgtgaccgactacggccacttcctgaaagaaatccccaactctttggaaatccggagaacttttgccgccaatctggagaaggccaacttactgcctaagggcgaccccgaacggagaaggctactgagcattgtggtggtgggtggagggcctacaggtgtagaggctgctggtgaactacaggactacgtgcaccaggacctgagaaagttcctccccgccttggccgaggaagtccagattcacctggtggaagctctgcccatcgtgttgaacatgtttgagaagaagcttagcagctacgcccagtcacatttagaaaacacctccatcaaggtgcatctgagaaccgctgtcgccaaagtggaagagaagcaactgttggccaagaccaagcacgaggacggcaagattaccgaggaaaccatcccctacggtactctgatttgggccacgggtaacaaggcaagacccgtaatcaccgaccttttcaagaagattcctgagcaaaactcgagcaagagaggactggccgtgaacgactttctgcaggtcaaaggcagcaacaacatcttcgccattggcgacaacgcctttgctggcctgccaccaacagcccaagtggcccaccaggaagccgaatacctggccaagaacttcgacaaaatggcccagataccaaatttccagaagaacctgtcttcccggaaggataaaatcgacctgctgttcgaggagaacaacttcaagcccttcaaatacaacgatctgggtgccttagcctacctgggcagcgaaagagccattgccaccatacgtagcggtaagagaaccttctacaccggcggaggcttaatgaccttctacctgtggcggatcttgtacctgagcatgatcctgtctgcccgcagcagactgaaggtgttcttcgactggattaagctggccttcttcaagagggacttctttaagggcctgtga

SEQ ID NO: 891 - DNA, 1542 bp, Artificial Sequence
  source: /note="Description of Artificial Sequence: Synthetic polynucleotide"
atgctaagcaagaacctgtatagtaacaagaggctgctgacctcgaccaacaccctcgtgcgcttcgcctccaccagatccaccggggtcgaaaacagcggggctggccccacatctttcaagaccatgaaggtcatcgaccctcagcacagcgacaaaccaaacgtgctgatactgggttctggctggggcgctatcagctttctgaagcacatcgacaccaagaagtacaacgtcagcatcatcagccctagaagctacttcctgttcacgcctctgctgccctctgcacctgtgggaacagtggacgagaagtcaatcattgagcccatcgttaatttcgctctcaagaaaaagggcaacgttacctactatgaggccgaagccaccagcatcaaccccgaccggaataccgtgaccatcaaaagcctgtctgccgtgagccagctataccagcctgagaaccacctggggctgcatcaagcagaacccgccgagattaagtacgactatctgatcagtgccgtgggcgccgagcctaacacatttggaatccccggcgtcactgattacggccatttcctgaaagaaatccccaactctttggaaatccggagaacttttgccgccaacctggagaaggccaacctgctgccaaagggcgatcccgagcggagaaggctactgagcatcgtggtcgtgggcggtggccccactggtgtggaggccgctggcgagctgcaggattacgttcaccaggacctgcggaagtttctccctgcattggccgaagaagtgcagattcacctggtcgaagccctgcccatcgttctgaacatgttcgagaaaaagctgtcatcatacgcccagtcacacctggaaaacacctccatcaaggtgcatctgagaaccgctgtggccaaagttgaagaaaagcaactgctggccaagacgaagcacgaggacggcaagattaccgaagaaaccatcccatacggtactctgatttgggccacgggcaacaaggcaagacccgtaatcaccgacctgttcaagaagattcccgagcaaaacagcagcaagagaggcttggcagtgaacgactttctgcaggtcaaaggcagcaacaacatcttcgccatcggcgacaatgcctttgctggcctgcctccaaccgcccaggtggcgcaccaggaagccgaatacctggccaagaacttcgataaaatggcccagataccaaatttccagaagaacctgtcctcccggaaggataagattgacctcttgttcgaggaaaacaactttaagcctttcaagtacaacgacctgggcgccctggcctacctgggaagcgaaagagccattgccaccatcagaagcggcaagcggaccttttacaccggcggaggcttaatgaccttctacttatggcggattctgtacttgtccatgatcctatctgcaagaagcagactgaaggtgtttttcgactggatcaaattagcctttttcaagagagacttcttcaagggcctgtag

SEQ ID NO: 892 - DNA, 1542 bp, Artificial Sequence
  source: /note="Description of Artificial Sequence: Synthetic polynucleotide"
atgctgagcaagaatctgtatagtaacaagcggctgctcacctcgaccaacacgctagtgcgcttcgccagcaccagatccaccggcgtggaaaactccggggcaggtcccacaagctttaagaccatgaaggtcatcgaccctcagcacagcgacaagcccaacgtgctgatactgggctcgggctggggagctatttcgtttttaaagcacatcgacaccaagaagtacaacgtttccatcatctctcccagaagctacttcctgttcacccctttgctgcctagcgccccagttggaacagtagacgagaagtccattatcgagcccatcgttaacttcgctctgaagaaaaagggcaacgtcacctactatgaggccgaagccacctctatcaaccccgaccggaacaccgttaccatcaaaagcttaagcgccgtgtcccagctgtaccaacccgagaaccatctggggctgcaccaggccgagcctgctgagattaagtacgactatttaatcagcgccgtaggcgcggaacccaacacctttggtatccccggggtgaccgactacggccacttcctgaaggaaattcccaactctttggaaatccggcggaccttcgccgccaatctagagaaggccaacctgctgcctaagggtgaccccgaacggagaagactgctgagcatcgtcgtcgtgggtggtggccctacaggcgtggaggctgctggtgaactacaggactacgttcaccaggacctgagaaagttcctgcccgccttggccgaggaagtgcagattcacttggtggaagccctgcccatcgtgctgaatatgtttgagaagaagctgagctcatacgcccagagccacctggaaaacacttccatcaaagtacacctgagaacggccgtggccaaagtggaagagaagcagttgctggcaaagaccaagcacgaagacggtaaaataaccgaggaaaccattccctacggtaccctgatttgggccaccggcaacaaggccagacccgtgatcaccgacctgttcaagaaaatccccgagcaaaactcgagcaagagaggattggcagtgaacgacttcttgcaggtgaaaggcagcaacaacatcttcgccatcggcgacaacgcatttgccggcttgccaccaacagcccaagtggcccaccaggaagccgagtacctggccaagaactttgataaaatggctcagatacccaatttccagaagaatctgtcctccagaaaggataaaatcgacctgctgttcgaggaaaacaacttcaagcccttcaagtacaacgatctgggcgccttagcctacctgggcagcgaaagagccattgccaccatcagaagcggtaagcggacattttacaccggtggaggcctgatgaccttctacctgtggcggatcttgtacctgtccatgatcctatctgcccgctcgagactgaaggtgtttttcgactggattaagctggcattcttcaagagggactttttcaaaggactgtga

SEQ ID NO: 893 - DNA, 1542 bp, Artificial Sequence
  source: /note="Description of Artificial Sequence: Synthetic polynucleotide"
atgctaagcaagaacctgtacagtaacaagaggctgctcaccagcaccaataccctcgtccgcttcgcctccaccagatccacaggggtggaaaacagcggagctggtcccaccagcttcaagaccatgaaggtcatcgaccctcagcacagcgacaagcccaacgtgctgatcctgggttctggctggggagccattagctttttaaagcacattgacaccaagaagtacaacgtcagcatcatcagccctagaagctacttcctgttcacccccctgttaccttctgccccagttggaaccgtggacgaaaagtcaatcattgagcccatcgttaacttcgccctgaagaaaaagggcaacgtcacctactacgaggccgaggccacctctatcaaccccgacaggaataccgttaccatcaagtcactgtctgccgtgtcccagctgtaccaacctgaaaaccacctaggcctgcaccaggccgaacctgccgagattaagtacgattacctgatcagtgctgtaggcgcggaacccaacacctttggtattcccggcgtgactgactacggccacttcctgaaagagattcccaactctctggaaatcagaagaactttcgccgccaacctggagaaggccaacttactgccaaagggcgatcccgagcggagaagactgctgtccattgtcgtggtgggcggaggccccactggcgtggaggctgctggcgaactacaggactacgtgcaccaggacctgagaaagtttctgcctgcactggccgaggaagtccaaattcacttggtggaagccctgcccatcgtgctgaacatgttcgagaaaaagcttagcagctacgcgcaatcacatttagaaaacacctccatcaaggtgcacctgagaacggctgtggccaaagttgaagaaaagcagctgctggccaagaccaagcacgaggacggcaagattaccgaggaaactatcccctacggcaccctgatttgggccaccggtaacaaggccagacccgtaatcaccgacctgttcaagaagatccctgagcagaactcgagcaagagaggactggccgtgaacgacttcctgcaagtgaaaggcagcaacaacattttcgccatcggtgacaacgcatttgctggcctgcctccaaccgcccaagtggcgcaccaggaagccgagtatctggccaagaacttcgataaaatggcccagatacccaatttccagaagaacctgtcttccagaaaggataagatcgacctcctgttcgaggaaaacaacttcaaacccttcaagtacaacgatctgggtgccttagcctacctgggctccgaaagggccattgccaccatcagaagcggtaagcggaccttctacaccggtggaggcttaatgaccttctacctgtggagaattctgtacctgagcatgattctgagcgcccgctcgagattaaaggtgtttttcgactggatcaagttagccttcttcaagagggacttttttaagggattatga

SEQ ID NO: 894 - DNA, 1542 bp, Artificial Sequence
  source: /note="Description of Artificial Sequence: Synthetic polynucleotide"
atgctgtcgaagaacctgtacagtaacaagcggctgctcacctcgaccaacaccctcgtcagattcgccagcaccagatccacaggggtggaaaacagcggggctggccctaccagcttcaagaccatgaaggtcattgacccccagcacagcgacaagcccaacgtgctgatcctgggctcgggctggggagccatttcgtttttaaagcacatcgacaccaagaagtacaacgttagcatcatctctcccagaagctatttcttattcacgcctctgctgcccagcgcaccagtgggaaccgtagacgagaagtccattatcgagcccatcgttaacttcgccctcaagaaaaagggcaacgtcacctactatgaggcagaggccaccagcatcaaccccgacaggaacaccgttaccataaagtcattaagcgccgtgagccagctgtaccagcctgagaaccacctaggcctgcaccaagccgagcccgctgagattaagtacgattatttaatcagtgccgtgggtgccgaacccaacacctttggtattcccggcgtgaccgactacggccatttcctgaaagagattcccaactctctggaaatccggagaacttttgccgccaacctggagaaggctaacctgctgcctaagggcgaccccgagagaagaagactactgtccatcgtggtcgtgggtggaggccctactggtgtagaagccgctggtgagctacaggattacgttcaccaggacctgcggaagttcctccccgcattggccgaagaagtgcaaattcacctggtggaagccctgcccatcgtgttgaacatgtttgagaagaagctgtcaagctacgcccagtcacacttagaaaacacttccatcaaggtacatctgagaaccgctgtggccaaggtggaagagaagcaattgttggccaagaccaaacacgaggacggtaaaattaccgaagaaaccatcccatacggcactctgatttgggccaccggtaacaaggcaagaccggtgatcaccgacctgttcaagaagatccccgagcagaacagcagcaagcggggactggcagtgaacgacttcttgcaagtgaaaggcagcaacaacattttcgccatcggcgacaatgcctttgccggcctgcctccaacagcccaggtggcgcaccaggaagccgaatacctggccaagaacttcgacaagatggctcagatccccaatttccagaagaacctgtcttcccggaaggataaaatcgacctcttgttcgaggagaacaacttcaagcccttcaagtacaacgatctgggtgccctggcctacctgggcagcgaaagagccattgccaccatcagatccggcaagagaaccttctacaccggcggaggcctgatgaccttctacttatggagaattctgtacttgagcatgattctgagcgcaagatcgagattaaaggtgttcttcgactggattaagctggccttcttcaaaagagacttcttcaaaggcctgtag

SEQ ID NO: 895 - DNA, 1542 bp, Artificial Sequence
  source: /note="Description of Artificial Sequence: Synthetic polynucleotide"
atgctaagcaagaacttgtacagtaacaagcggttgctcaccagcacgaacaccctcgtcagattcgcctccaccagatccacaggcgtggaaaactccggagctggccccaccagctttaagaccatgaaagtcatcgacccccagcacagcgacaagccaaacgtgctgatcctgggctctggctggggcgctatctcgtttctgaagcacattgacaccaagaagtacaacgtctccatcatctctcccagaagctatttcatcttcacccccctgctgcccagcgcaccagtggggacagtggacgaaaagtccatcatcgagcccatcgtgaacttcgccctgaagaaaaagggcaacgtcacctactatgaggcagaggccacctctatcaaccccgaccggaacaccgtgaccatcaagtcactgagcgccgttagccagctgtaccagcccgaaaaccacctgggcctgcaccaggccgagcccgccgagattaagtacgactatttaatcagtgccgtaggcgcggaacctaacacctttggtatccccggcgtgaccgactacggtcacttcctgaaggaaatccccaacagcctggaaataagaagaaccttcgccgccaacctagagaaggccaacttattgcctaagggcgaccccgagcggagaagactgctgtccattgtggtggttggcggtgggcccactggtgtagaagccgctggtgagctacaggactacgttcaccaggacctgcggaagttcctgcctgccctggccgaggaagtgcagattcacttggtcgaagctctgcccatcgttttgaacatgtttgagaagaagctgagctcatacgcccaaagccatctggaaaacacctcgatcaaagtacacctgagaaccgctgtcgccaaggttgaagaaaagcagctgctggccaagacgaagcacgaggacggtaagattaccgaggaaactatcccctacggtaccttgatttgggccaccggcaacaaggccagacccgtgatcaccgacctgttcaagaagatccctgagcaaaactcgagcaagagaggcttggccgtgaacgacttcctgcaggtcaaaggcagcaacaacatcttcgccattggcgacaacgcctttgccgggttgcctccaacagcccaggtggcccaccaggaggccgagtatctggccaagaactttgacaagatggcccagataccaaatttccaaaagaatctatcttcccggaaggataagatcgatctgttgttcgaggaaaacaactttaaacctttcaagtacaacgatttaggtgccctggcctacctgggcagcgaaagggccattgcaaccataagatccggcaagagaaccttctacaccggcggtggcctgatgaccttctacctgtggcggattctgtacttgagcatgattctgagcgcccgcagcagattaaaggtcttcttcgactggatcaagctggccttcttcaaaagagacttcttcaagggattatag

SEQ ID NO: 896 - DNA, 1542 bp, Artificial Sequence
  source: /note="Description of Artificial Sequence: Synthetic polynucleotide"
atgctatcgaagaatctgtacagcaacaagaggttgctgaccagcacgaataccctcgtgagattcgcttccaccagatccaccggggtggaaaactccggagctggtcccacctctttcaagaccatgaaaatcattgacccccagcacagcgacaaaccaaacgtgctgatactgggctctggctggggcgccatcagctttttaaagcacatcgacaccaagaagtacaacgtcagcatcatcagccccagaagctatttcttattcacccccctgttaccctctgccccagtgggaaccgtggacgagaagtccattattgagcccatcgtgaacttcgctctcaagaaaaaggggaacgtcacctactacgaggccgaagccaccagcatcaatcccgaccggaacaccgttaccataaaaagcctgagcgccgtgtcccagctgtaccaacctgagaaccacctaggcctgcatcaggccgagcccgccgaaattaagtacgactacctgatcagtgccgtgggtgcggaacccaacacctttggtattcccggcgtcactgattacggccacttcctgaaagagatccccaacagcttggaaatcagaagaactttcgccgccaatctggagaaggccaacttactgcctaagggcgatcccgaacggagaaggctactgagcattgtggtggtgggcggaggccctactggcgtagaggccgctggtgaactacaggactacgtgcaccaggacctgcggaagttcctgcctgccttggccgaagaagtgcaaattcacctggtggaagccctgcccatcgtgctgaacatgtttgagaaaaagcttagcagctacgcccagtcacacctggaaaacacctccatcaaggtacacctgagaacggccgtggccaaggttgaagagaagcagttgctggccaagaccaaacacgaggacggcaagattaccgaggaaactatcccctacggtactctgatttgggccaccggtaacaaggcaagaccggtgatcaccgacctgttcaagaagattcccgagcagaacagcagcaagagaggattggcagtgaacgactttttgcaggtcaaaggcagcaacaacattttcgccattggcgacaacgcctttgctgggctgccacctaccgcccaggtggcgcaccaggaagccgagtacttggccaagaactttgacaaaatggcccagatccccaatttccaaaagaacctatcttcacggaaggataaaattgacctcctgttcgaggaaaacaacttcaagcccttcaagtacaacgatttaggcgccctggcctacctgggcagcgaaagggccattgccaccatcagatccggtaagagaaccttctacaccggcggaggcctgatgaccttctacctgtggcggatcttgtacctgtccatgatcctgtctgcccgcagcagactgaaggtgttcttcgactggatcaagttagcatttttcaagagagactttttcaagggactgtag

SEQ ID NO: 897 - DNA, 1542 bp, Artificial Sequence
  source: /note="Description of Artificial Sequence: Synthetic polynucleotide"
atgctgtcgaagaacttgtacagcaacaagcggttgctgaccagcaccaacaccctagtgcgcttcgccagcaccagatccaccggcgtggaaaactccggagctggtcctaccagctttaagaccatgaaagtcatcgacccccagcacagcgacaagcccaacgtgctgatcctgggttctggctggggagccatctcgtttctgaagcacatcgacaccaagaagtacaacgttagcatcgtgtctcctagaagctacttcttattcacccccttgctgccctctgccccagtggggacagtggacgagaagtcaattatcgagcccatcgttaattttgccctgaagaaaaaggggaacgttacctactacgaggcagaggccaccagcatcaatcccgacaggaataccgtgaccatcaagtcactgagcgccgtgagccagctataccagcctgagaaccacctggggctgcatcaagccgaacccgccgagattaagtacgactacttaatcagcgctgtaggtgccgagcccaacacatttggtatccccggcgtgaccgactacggccacttcctgaaggaaatccccaacagcctggaaatccggagaactttcgccgccaacctggagaaggccaacctgctgcctaagggcgatcccgaaagaagaaggctgctgagcatcgtggtggtgggcggtggccccacaggcgtggaggccgctggtgaactgcaggattatgttcaccaggacctgagaaagttcctgcctgcactggccgaggaagtgcagattcacctggtggaagccctgcccatcgtgttgaatatgttcgagaagaagctgagctcatacgcccaaagccacctggaaaacacttccatcaaggtgcatctgagaacggccgtcgccaaagtggaagagaagcaattgttggcaaagacgaaacacgaggacggcaaaattaccgaggaaactattccctacggcactctgatttgggccacgggtaacaaggcaagaccggtgatcacagacctgttcaagaaaatccctgagcagaacagcagcaagcggggactggcagtgaacgactttctgcaggtcaaaggcagcaacaacattttcgccatcggcgacaatgcctttgctggcttgccacctaccgcccaggtggcccaccaggaagccgaatacctggccaagaactttgacaagatggcccaaatacccaatttccaaaagaacctgtcctcccggaaggataaaatcgatctcctgttcgaggagaacaacttcaagcccttcaaatacaacgatttaggtgccctggcctacctgggcagcgaaagagccattgcaaccatcagaagcggcaagagaaccttttacaccggtggaggcctgatgaccttctacctgtggagaatcctgtacttgagcatgatcctgagcgcacgcagcagattaaaggtgtttttcgactggatcaagctggcctttttcaaaagggacttctttaagggattatga

SEQ ID NO: 898 - DNA, 1542 bp, Artificial Sequence
  source: /note="Description of Artificial Sequence: Synthetic polynucleotide"
atgctaagcaagaacctgtatagcaacaagaggttgctgaccagcaccaataccctcgtccgcttcgctagcaccagatccacaggggtggaaaacagcggagctggtcctacaagcttcaagaccatgaaggtcatcgacccccagcacagcgacaaacccaacgtgctgatcctgggttctggctggggagccatctcgtttctgaagcacatcgacaccaagaagtacaacgtttccatcatcagccctagaagctatttcttattcacccccttgctgcccagcgcccctgtgggaacagtggacgaaaagtccatcattgagcccatcgttaacttcgccctgaagaaaaagggcaacgtcacctactacgaggccgaggccacctctatcaatcccgacaggaacaccgtgaccatcaagagcttaagcgccgtttcccagctgtaccagcctgagaaccatctagggctgcatcaggcagagcctgctgagattaagtacgactatctgatcagtgctgtaggcgcggagcctaacacatttggtatccccggcgtgaccgattacggccacttcctgaaagagattcccaactctctggaaataagacggaccttcgccgccaacctggaaaaggccaacctgctgcctaagggcgaccccgagcggagaaggctgctgtccatcgtggtggttggtggagggcctactggcgtggaggctgctggcgagctgcaggactatgtgcaccaggacctgcggaagtttctgcccgccctggccgaagaagtgcagattcacctggtggaagctctgcccatcgtgttgaatatgtttgagaaaaagctgtcatcatacgcccagtcacacttagaaaacacttccatcaaggtacacctgagaaccgctgtcgccaaagttgaagaaaagcagctgttggcaaagaccaaacacgaggacggcaaaattaccgaagaaaccatcccatacggcactctgatttgggccaccggcaacaaggccagacccgtgatcaccgaccttttcaagaagatccccgagcaaaactcgtccaagcggggcctggccgtgaatgacttcctgcaggtcaaaggcagcaacaacatcttcgccatcggcgacaatgcatttgccggcttgcctcctacagcccaggtggcgcaccaagaggccgagtacctggccaagaactttgataagatggctcagatccccaatttccagaagaatctatcctccagaaaggataaaatcgacctgttgttcgaggaaaacaacttcaagcccttcaaatacaacgatctgggcgccttagcatacctgggaagcgaaagagccattgccaccataagatccggcaagagaaccttttacaccggtggtggcctgatgaccttctacttatggcggatcctgtacatgtccatgattctgagcgccagaagcagattaaaggtgttcttcgactggattaagttagcattcttcaaaagggactttttcaaaggcctgtag

SEQ ID NO: 899 - DNA, 1542 bp, Artificial Sequence
  source: /note="Description of Artificial Sequence: Synthetic polynucleotide"
atgctgtcgaagaacctgtatagcaacaagcggttgctgaccagcacgaataccctcgtgagattcgcctccaccagatccaccggggtcgaaaactccggggcaggccctacctcttttaagaccatgaagatcatcgacccccagcacagcgacaagccaaacgtgctgatcctgggctcgggctggggcgctatcagctttctgaagcacatcgacaccaagaagtacaacgtctccatcatcagccccagaagctatttcttatttacgcccttgctgccttctgcccctgtgggaaccgtggacgagaagtccatcatcgagcccatcgttaacttcgccctcaagaaaaagggcaacgttacctactacgaggccgaagccaccagcatcaaccccgaccggaataccgtgaccatcaaaagcctgtctgccgtgagccagctataccagcccgaaaaccacctggggctgcaccaggcagaacctgccgagattaagtacgactacttaatcagcgccgtgggtgccgagcctaacacatttggtatccccggcgtcaccgactacggccacttcctgaaagagatccccaacagcttggaaataagaagaactttcgccgccaacctagagaaggctaacttattgcctaagggcgaccccgaacggagaaggctactgagcattgtggtcgtgggtggtgggcccactggcgtggaggccgctggtgagctgcaggattatgttcaccaggacctgcggaagtttctccctgccttggccgaagaagtgcaaattcacttggtggaagctctgcccatcgttctgaatatgttcgagaagaagctgtcaagctacgcccagtcacatttagaaaacacttcgatcaaagtgcatctgagaaccgccgtggccaaggtggaagagaagcagctgctggccaagaccaagcacgaagacggcaaaattaccgaagaaaccattccatacggcaccctgatttgggccaccggcaacaaggccagacccgtgatcaccgaccttttcaagaaaattcccgagcagaactcgagcaagcggggcctggccgtgaatgacttcctgcaggtcaaaggcagcaacaacatcttcgccatcggcgacaatgcctttgctgggctgccacctaccgcccaagtggcgcaccaggaggccgaatacctggccaagaacttcgacaagatggcccagatacccaatttccagaagaacctatcctcacggaaggataagattgacctcttgttcgaggaaaacaacttcaaacctttcaaatacaacgacctgggtgccctggcctacctgggaagcgaaagagccattgcaaccatccgttccggcaagagaaccttttacaccggcggtggcctgatgaccttctacttatggagaatcttgtacttgagcatgattctgagcgcacgcagcagattaaaggtgttcttcgactggatcaagttagccttcttcaagagggacttcttcaagggcctgtag

SEQ ID NO: 900 - DNA, 1542 bp, Artificial Sequence
  source: /note="Description of Artificial Sequence: Synthetic polynucleotide"
atgctaagcaagaatctgtacagcaacaagaggttgctgaccagcacgaatacgctagtgagattcgcttccaccagatccacaggcgtggaaaacagcggggctggccccacctcttttaagaccatgaaaatcattgacccccagcacagcgacaagcccaacgtgctgatcctgggttcgggctggggagccatcagctttctgaagcacatcgacaccaagaagtacaacgtctccatcatcagccccagaagctacttcctgttcacgcccttgctgccctctgcccctgtggggaccgtagacgagaagtccatcattgagcccatcgtgaactttgctctgaagaaaaagggcaacgtcacctactacgaggccgaagccaccagcatcaaccccgaccggaacaccgtgaccataaagtcattaagcgccgtgtcccagctgtaccaacctgaaaaccacctagggctgcaccaggccgagcccgccgagattaagtacgactacttaatcagtgccgtgggcgcggagcctaacacctttggaatccctggcgtgaccgattacggtcatttcctgaaagagattcccaacagcttggaaatcagaagaaccttcgccgccaatctagaaaaggccaacctgttgcctaagggtgaccccgagcggagaaggctgctgtccattgtcgtggttggtggaggccctactggcgtagaagctgctggcgaactacaggattacgtgcaccaggacctgcggaagtttctgcctgccctggccgaggaagtgcagattcacctggtcgaagctctgcccatcgttttgaatatgtttgagaagaagctgagctcatacgcccagagccacctggaaaacacttcgatcaaagtacatctgagaaccgctgtcgccaaggtggaagagaagcagttgctggcaaagaccaagcacgaggacggtaagattaccgaagaaaccatcccatacggcactctgatttgggccaccggtaacaaggccagacccgtgatcaccgacctgttcaagaagattcccgagcagaactcgtccaagagaggcctggcagtgaacgacttcctgcaggtcaaaggcagcaacaacattttcgccattggtgacaacgcatttgccgggttgccacctacagcccaagtggcccaccaggaggccgaatacctggccaagaacttcgataagatggcccagatacccaatttccaaaagaacctatcttcacggaaggataagatcgacctgctgttcgaggaaaacaactttaagcccttcaagtacaacgatctgggcgccttagcctacctgggcagcgaaagggccattgccaccatcagatccggtaagagaacattttacaccggcggaggcttaatgaccttctacttatggcggatcctgtacttgagcatgatcctaagcgcaagaagcagattaaaggtgttcttcgactggatcaagttagcctttttcaagagggacttctttaagggcttatga

SEQ ID NO: 901 - DNA, 1542 bp, Artificial Sequence
  source: /note="Description of Artificial Sequence: Synthetic polynucleotide"
atgctaagcaagaacctgtacagtaacaagaggctgctcaccagcacgaacacgctcgtgagattcgccagcaccagatccaccggcgtcgaaaactccggagcaggccctacctcttttaagaccatgaaaatcattgacccccagcacagcgacaagcccaacgtgctgatactgggttctgggtggggagctatcagctttctgaagcacatcgacaccaagaagtacaacgtttccatcatctctcccagaagctacttcttattcacccccttgttacccagcgcccctgttggaaccgtggacgagaagtccatcatcgagcccatcgtgaactttgccctgaagaaaaaggggaacgtcacctactacgaggcagaggccaccagcatcaatcccgacaggaataccgtgaccataaagagcctgtctgccgtgagccagctataccagcccgagaaccacctgggcctgcatcaggcagagcctgccgaaattaagtacgactacctgatcagcgctgtaggcgccgaacccaacacctttggaatccccggcgtgactgactacggtcacttcctgaaggagatccccaacagcctggaaatccggagaaccttcgccgccaacctggagaaggccaacttactgcctaagggcgaccccgagagaagaaggctactgtccattgtcgtcgtgggcggagggcccactggcgtagaagctgctggtgagctgcaggattatgttcaccaggacctgagaaagttcctccccgcattggccgaagaagtccagattcacttggtggaagctctgcccatcgtgttgaatatgttcgagaaaaagctgagcagctacgcccagtcacatctggaaaacacttccatcaaggtgcacctgagaaccgccgtcgccaaggttgaagagaagcaattgctggcaaagaccaagcacgaggacggcaaaataaccgaagaaactattccctacggcactctgatttgggccaccggcaacaaggccagaccggtgatcacagacctgttcaagaagattcccgagcagaactcgagcaagcggggattggccgtgaacgacttcctgcaggtcaaaggcagcaacaacatcttcgccatcggcgacaacgcctttgccggcttgccacctaccgcccaagtggcccaccaagaagccgagtacttggccaagaactttgacaagatggctcagatcccaaatttccagaagaacctatcctcacggaaggataagattgacctgctgttcgaggagaacaacttcaaacccttcaagtacaacgacttaggcgccttagcatacctgggctccgaaagagccattgcaaccatcagaagcggtaagagaaccttttacaccggcggtggcctgatgaccttctacttatggagaatcttgtacttgagcatgatcctatctgcccgctcgagattaaaggtgtttttcgactggattaagttagcctttttcaagagggacttttttaagggcctgtga

SEQ ID NO: 902 - DNA, 1542 bp, Artificial Sequence
  source: /note="Description of Artificial Sequence: Synthetic polynucleotide"
atgctaagcaagaacttgtacagcaacaagcggctgctcaccagcaccaacacgctcgtcagattcgctagcaccagatccaccggcgtcgaaaactccggggcaggtcccaccagcttcaagaccatgaaagtcatcgacccccagcacagcgacaagccaaacgtgctgatactgggctcgggctggggcgctatctcgtttctgaagcacatcgacaccaagaagtacaacgtttccatcatcagccccagaagctatttcatcttcacccccttgctgcctagcgcacctgtggggacagtggacgagaagtccatcattgagcccatcgttaacttcgccctcaagaaaaagggcaacgttacctactacgaggcagaggccaccagcatcaatcccgaccggaacaccgtgaccatcaagagcctgtctgccgtttcccagctgtaccaacctgaaaaccatctggggctgcaccaggccgaacctgctgaaattaagtacgattacttaatcagtgccgtaggcgccgagcctaacacctttggaatccccggcgtcaccgactacggccacttcctgaaagaaatccccaacagcctggaaatccggcggaccttcgccgccaacctggagaaggccaacctgctgccaaagggtgatcccgaacggagaagactgctgagcattgtcgtcgtgggcggtggccccacaggtgtggaagctgctggcgaactacaggattacgtgcaccaggacctgagaaagtttctccctgccctggccgaggaagtgcaaattcacttggtggaagccctgcccatcgttctgaacatgtttgagaagaagctgtcaagctacgcgcagtcacacttagaaaacacctccatcaaagtgcacctgagaaccgccgtggccaaggttgaagaaaagcagctgttggccaagaccaagcacgaggacggcaagataaccgaagaaactatcccatacggcactctgatttgggccaccggcaacaaggccagaccggtaatcaccgacctgttcaagaagatccctgagcaaaacagcagcaagcggggcctggccgtgaatgactttttgcaggtgaaaggcagcaacaacatcttcgccatcggcgacaacgcatttgctgggttgccaccaacagcccaggtggcgcaccaggaagccgaatatttggccaagaacttcgacaagatggctcaaatacccaatttccagaagaatctgtcctcacggaaggataaaatcgacctgttgttcgaggagaacaacttcaaacctttcaaatacaacgatctgggcgccttagcatacctgggctccgaaagggccattgccaccatacgtagcggtaagcggacattctacaccggcggaggcttaatgaccttctacctgtggcggatcttgtacctgagcatgatcctgagcgcacgcagcagactgaaggtgtttttcgactggatcaagctggcctttttcaaaagggacttttttaagggcttatag

SEQ ID NO: 903 - DNA, 1542 bp, Artificial Sequence
  source: /note="Description of Artificial Sequence: Synthetic polynucleotide"
atgctgtcgaagaatctgtatagtaacaagcggctgctgaccagcaccaataccctagtccgcttcgcttccaccagatccaccggggtcgaaaactccggggctggtcccacctctttcaagaccatgaaggtcatcgacccccagcacagcgacaaacccaacgtgctgatcctgggctctgggtggggcgccatcagctttctgaagcacattgacaccaagaagtacaacgtctccatcatcagccctagaagctacttcatctttacccccttgttacctagcgcccctgttggaacagtggacgagaagtcaattatcgagcccatcgttaactttgctctgaagaaaaaggggaacgttacctactacgaggcagaagccaccagcatcaatcccgacaggaataccgtgaccatcaagagcttaagcgccgtttcccagctataccagcccgaaaaccacctggggctgcatcaagccgaacctgccgagattaagtacgattacttaatcagtgccgtgggcgccgagcccaacacctttggaattcccggcgtcaccgattacggccatttcctgaaagaaatccccaacagcctggaaatcagacggaccttcgccgccaacctggagaaggccaacttactgcctaagggtgaccccgagcggagaaggctactgtccatcgtggtggtgggtggagggcctactggcgtggaggctgctggtgagctgcaggactacgtgcaccaggacctgcggaagttcctccccgccctggccgaagaagtgcagattcacctggtcgaagccctgcccatcgttctgaatatgttcgagaagaagcttagcagctacgcccagagccacctggaaaacacttccatcaaggtgcacctgagaaccgccgtggccaaagttgaagagaagcaattgctggccaagacgaagcacgaggacggtaagattaccgaggaaaccatcccatacggcaccttgatttgggccaccggtaacaaggcaagacccgtgatcaccgaccttttcaagaagattcccgagcaaaacagctccaagcggggcctggccgtgaacgactttctgcaggtgaaaggcagcaacaacatcttcgccattggcgacaatgcctttgccggcttgccaccaacagcccaagtggcccaccaggaggccgagtatttggccaagaactttgataagatggcccagataccaaatttccagaagaacctatcctcaagaaaggataagatcgatctgctgttcgaggaaaacaacttcaagcccttcaaatacaacgatttaggtgccctggcctacctgggaagcgaaagagccattgcaaccatccgttccggtaagcggaccttctacaccggcggtggcctgatgaccttctacctgtggagaatcttgtacttgagcatgatcctaagcgcaagaagcagactgaaggtgtttttcgactggatcaaactggcatttttcaagagagacttcttcaaaggcttatag

SEQ ID NO: 904 - DNA, 1542 bp, Artificial Sequence
  source: /note="Description of Artificial Sequence: Synthetic polynucleotide"
atgctgagcaagaatttgtatagtaacaagcggctgctgaccagcacgaataccctagtgcgcttcgcttccaccagatccaccggcgtcgaaaacagcggggctggccccaccagcttcaagaccatgaaggtcattgacccccagcacagcgacaaaccaaacgtgctgatcctgggctctggctggggagccattagctttctgaagcacatcgacaccaagaagtacaacgtttccatcatcagccctagaagctacttcctgttcacccctttgctgccctctgccccagtggggacagtggacgagaagtcaatcattgagcccatcgtgaacttcgctctcaagaaaaagggcaacgtcacctactacgaggccgaagccaccagcatcaaccccgaccggaacaccgttaccatcaaaagcttaagcgccgtgagccagctgtaccagcctgagaaccacctgggcctgcatcaagcagagcctgccgaaattaagtacgactacctgatcagtgctgtgggcgccgagcctaacacctttggaattcctggcgtgactgactacggtcatttcctgaaagaaatccccaacagcctggaaatacggcggacctttgccgccaacctagaaaaggccaacctgctgccaaagggtgatcccgagagaagaagactactgtccatcgtggtggtgggcggaggccctactggcgtagaagctgctggcgagctacaggattacgtgcaccaggacctgcggaagttcctgcctgcattggccgaagaaatccagattcacttggtggaagccctgcccatcgttttgaacatgttcgagaaaaagctgagctcatacgcccaaagccatctggaaaacacctccatcaaggtacacctgagaacggctgtggccaaagttgaagaaaagcagctgctggccaagacgaagcacgaagacggcaaaataaccgaagaaaccattccatacggcaccctgatttgggccaccggcaacaaggccagaccggtgatcacagaccttttcaagaaaatccccgagcaaaacagctccaagcggggactggcagtgaacgactttttgcaggtcaaaggcagcaacaacattttcgccattggtgacaacgcctttgccgggctgccacctaccgcccaggtggcccaccaggaagccgagtacctggccaagaatttcgacaagatggcccagatcccaaatttccagaagaacctgtcttccagaaaggataagattgacctcttgttcgaggagaacaacttcaagcccttcaaatacaacgacctgggtgccttagcctacctgggcagcgaaagagccattgcaaccatcagatccggcaagcggaccttctacaccggcggaggcttaatgaccttctacttatggcggatcctgtacttgagcatgatcctgagcgcacgcagcagactgaaggtctttttcgactggattaagctggcctttttcaagagagacttctttaaaggattatga

SEQ ID NO: 905 - DNA, 1542 bp, Artificial Sequence
  source: /note="Description of Artificial Sequence: Synthetic polynucleotide"
atgctgtcgaagaacctgtacagtaacaagaggctgctgaccagcaccaataccctagtccgcttcgcctccaccagatccacaggcgtcgaaaacagcggggcaggccctacctctttcaagaccatgaagatcatcgacccccagcacagcgacaagcccaacgtgctgatactgggctctggctggggagctattagctttttaaagcacatcgacaccaagaagtacaacgtttccatcatctctcccagaagctacttcttatacacgcccttgttacccagcgcacctgtggggaccgtggacgagaagtccattattgagcccatcgtgaactttgccctcaagaaaaagggcaacgtcacctactacgaggcagaggccaccagcatcaatcccgacaggaacaccgtgaccataaaaagcctgagcgccgtttcccagctgtaccagcctgagaaccatctagggctgcaccaagcagagcccgccgaaattaagtacgactatctgatcagtgccgtgggcgcggagcccaacacatttggtatccctggcgtgaccgactacggtcacttcctgaaagaaattcccaactctctggaaatccggagaacctttgccgccaacctagagaaggccaacttactgcctaagggtgaccccgagagaagaaggctactgtccattgtcgtcgttggcggagggcccactggcgtggaggctgctggcgagctgcaggactacgttcaccaggacctgcggaagtttctgcccgccttggccgaggaagtgcagattcacttggtggaagccctgcccatcgttctgaatatgtttgagaagaagcttagctcatacgcgcagtcacatttagaaaacacttccatcaaggtacatctgagaacggccgtggccaaggtggaagaaaagcagttgttggccaagaccaaacacgaagacggcaagattaccgaggaaactatcccctacggcaccttgatttgggccaccggtaacaaggccagaccggtaatcaccgacctgttcaagaaaattcccgagcagaactcgagcaagcggggcctggcagtgaacgactttttgcaagtgaaaggcagcaacaacatcttcgccattggtgacaacgcctttgccgggttgcctcctacagcccaggtggcccaccaggaggccgaatacctggccaagaactttgataaaatggctcagataccaaatttccagaagaacctgtcttcccggaaggataaaatcgacctcctgttcgaggaaaacaacttcaaacctttcaagtacaacgacctgggcgccttagcctacctgggaagcgaaagagccattgccaccatacgtagcggcaagcggaccttctacaccggcggaggcctgatgaccttctacctgtggcggattctgtacctgagcatgatcctgagcgcacgcagcagactgaaggtcttcttcgactggattaagctggccttcttcaagagggacttctttaagggcttatga

SEQ ID NO: 906 - DNA, 1542 bp, Artificial Sequence
  source: /note="Description of Artificial Sequence: Synthetic polynucleotide"
atgctaagcaagaacttgtacagcaacaagcggctgctgaccagcaccaatacgctagtgagattcgcctccaccagatccaccggcgtcgaaaacagcggggctggccccacctctttcaagaccatgaaagtcatcgacccccagcacagcgacaaacccaacgtgctgatcctgggctctgggtggggagctattagctttttaaagcacatcgacaccaagaagtacaacgtctccatcgtgagccccagaagctatttcctgtttacgcccctgctgcctagcgccccagtggggaccgtagacgaaaagtccattattgagcccatcgtgaatttcgccctcaagaaaaagggcaacgtcacctactatgaggcagaagccaccagcatcaaccccgacaggaacaccgtgaccatcaagagcctgagcgccgtgtcccagctgtaccagcccgagaaccatctggggctgcatcaggcagagcccgccgaaattaagtacgactacctgatcagcgctgtgggcgccgaacccaacacatttggtattcctggcgtgaccgattacggtcatttcctgaaagagatccccaacagcctggaaataagacggactttcgccgccaacctagagaaggctaacctgctgccaaagggtgaccccgagagaagaaggctactgtccatcgtcgtcgtgggtggtggccccacaggtgtggaagctgctggcgagctacaggactacgtgcaccaggacctgcggaagtttctgcctgccctggccgaggaaatccaaattcacttggtggaagctctgcccatcgtgttgaacatgttcgagaaaaagctgagcagctacgcgcaaagccacttagaaaacacttcgatcaaggtgcacctgagaaccgccgtggccaaggtggaagaaaagcagttgttggccaagacgaagcacgaagacggtaagataaccgaggaaaccattccctacggtaccctgatttgggccacgggcaacaaggcaagacccgtaatcacagacctgttcaagaaaattcccgagcaaaactcgagcaagagaggcctggccgtgaacgactttttgcaagtcaaaggcagcaacaacattttcgccattggcgacaatgcctttgccggcctgcctcctaccgcccaagtggcccaccaggaggccgaatacctggccaagaatttcgataagatggctcagatccccaatttccaaaagaatctgtcctcaagaaaggataagatcgatctgttgttcgaggaaaacaacttcaagcccttcaagtacaacgatttaggcgccttagcatacctgggaagcgaaagagccattgcaaccatcagatccggcaagagaaccttttacaccggtggaggcctgatgaccttctacctgtggagaatcctgtacctgtccatgatcctaagcgcccgctcgagactgaaggtgttcttcgactggatcaagttagccttcttcaaaagagactttttcaagggcttatga

SEQ ID NO: 907 - DNA, 1542 bp, Artificial Sequence
  source: /note="Description of Artificial Sequence: Synthetic polynucleotide"
atgctaagcaagaatctgtacagtaacaagcggctgctcacctcgaccaacaccctcgtgcgcttcgctagcaccagatccacaggggtcgaaaacagcggggctggccccaccagcttcaagaccatgaaggtcatcgaccctcagcacagcgacaagcccaacgtgctgatcctgggctctgggtggggcgctatcagctttttaaagcacatcgacaccaagaagtacaacgtttccatcgtgagccccagaagctatttcatcttcacccccctgctgcccagcgcaccagtggggaccgtggacgagaagtcaatcattgagcccatcgtgaatttcgctctgaagaaaaaggggaacgttacctactatgaggcagaggccaccagcatcaatcccgaccggaacaccgtgaccatcaaatcattaagcgccgttagccagctataccagcctgagaaccatctaggcctgcaccaggccgagcctgctgaaattaagtacgactatctgatcagtgctgtaggcgccgagcctaacacatttggtattcccggggtcactgattacggccacttcctgaaagaaattcccaacagcctggaaatcagacggacctttgccgccaacctagagaaggctaacttactgcctaagggcgatcccgagagaagaaggctactgagcatcgtggtggttggcggagggcctactggcgtagaagccgctggcgaactacaggattacgttcaccaggacctgcggaagttcctgcccgccctggccgaggaagtccagattcacctggtggaagctctgcccatcgtgctgaacatgttcgagaaaaagctgagctcatacgcgcagtcacatctggaaaacacttcgatcaaagtgcacctgagaaccgctgtggccaaggtggaagagaagcaactgttggccaagaccaagcacgaggacggcaagattaccgaggaaaccattccctacggcaccctgatttgggccaccggtaacaaggccagaccggtgatcacagacctgttcaagaagatccccgagcagaacagcagcaagagaggattggccgtgaacgacttcttgcaggtgaaaggcagcaacaacatcttcgccattggcgacaacgcatttgccggcctgccaccaaccgcccaggtggcccaccaggaggccgagtacctggccaagaactttgataagatggctcaaatacccaatttccaaaagaatctatcctcacggaaggataagatcgatctgttgttcgaggaaaacaacttcaaacctttcaagtacaacgatttaggtgccctggcatacctgggaagcgaaagagccattgccaccatcagaagcggtaagcggaccttttacaccggcggaggcctgatgaccttctacctgtggagaatcctgtacctgtccatgattctgagcgcccgcagcagactgaaggtcttcttcgactggatcaaactggcattcttcaaaagagacttcttcaagggactgtga

SEQ ID NO: 908 - DNA, 1542 bp, Artificial Sequence
  source: /note="Description of Artificial Sequence: Synthetic polynucleotide"
atgctaagcaagaacctgtacagcaacaagaggctgctcaccagcaccaacacgctcgtgcgcttcgctagcaccagatccacaggcgtggaaaacagcggggctggccctaccagctttaagaccatgaaggtcattgacccccagcacagcgacaagccaaacgtgctgatactgggctctggctggggcgctattagctttctgaagcacattgacaccaagaagtacaacgttagcatcatctctcctagaagctacttcatcttcacccctctgctgcctagcgcaccagtggggacagtggacgaaaagtccatcattgagcccatcgtgaatttcgccctgaagaaaaagggcaacgttacctactacgaggccgaggccaccagcatcaaccccgaccggaacaccgtgaccatcaaaagcctgagcgccgtgtcccagctataccagcccgaaaaccacctagggctgcaccaagccgagcctgccgaaattaagtacgactatctgatcagcgccgtaggcgccgagcccaacacatttggaatccccggcgtgaccgactacggccacttcctgaaagagatccccaacagcttggaaatcagacggacctttgccgccaacctagagaaggccaacctgttgccaaagggcgaccccgaacggagaaggctgctgtccattgtcgtggtgggcggaggccctactggtgtggaggccgctggcgaactgcaggattacgtgcaccaggacctgagaaagtttctgcctgcattggccgaggaagtgcagattcacttggtcgaagctctgcccatcgttttgaacatgttcgagaaaaagctgagctcatacgcgcagtcacacctggaaaacacctcgatcaaagtacacctgagaacggccgtcgccaaggtggaagaaaagcagctgctggccaagaccaagcacgaagacggcaagataaccgaagaaaccattccatacggcaccttgatttgggccaccggtaacaaggcaagacccgtaatcacagaccttttcaagaaaattcccgagcagaactcgtccaagcggggactggcagtgaacgactttttgcaggtcaaaggcagcaacaacatcttcgccatcggcgacaacgcatttgccgggctgcctcctacagcccaggtggcccaccaagaagccgaatacttggccaagaatttcgataagatggctcagatcccaaatttccaaaagaatctatcctcacggaaggataaaatcgacctcttgttcgaggaaaacaacttcaagcccttcaaatacaacgacctgggcgccttagcatacctgggctccgaaagagccattgccaccatcagatccggcaagcggaccttttacaccggcggaggcctgatgaccttctacctgtggagaatcatctacctgtccatgatcctaagcgcacgctcgagactgaaggtctttttcgactggatcaaactggccttcttcaagagggactttttcaagggactgtag

SEQ ID NO: 909 - DNA, 1542 bp, Artificial Sequence
  source: /note="Description of Artificial Sequence: Synthetic polynucleotide"
atgctatcgaagaacttgtacagcaacaagcggttgctgacctcgaccaacaccctagtcagattcgcctccaccagatccacaggggtcgaaaacagcggggcaggtcccacctctttcaagaccatgaagatcatcgacccccagcacagcgacaagcccaacgtgctgatcctgggttcgggctggggcgccatttcgtttctgaagcacatcgacaccaagaagtacaacgtcagcatcgtgagccccagaagctacttcttatttacccctttgttaccttctgcaccagtggggaccgtggacgagaagtcaatcattgagcccatcgttaacttcgctctgaagaaaaaggggaacgtcacctactacgaggcagaggccaccagcatcaaccccgacaggaacaccgttaccatcaagtcactgtctgccgtgagccagctgtaccagcccgagaaccatctagggctgcaccaagcagagcccgccgagattaagtacgactacctgatcagtgccgtgggtgccgagcccaacacatttggaattcccggggtgactgactacggccacttcctgaaagagatccccaactctctggaaatccggagaaccttcgccgccaacctggaaaaggccaacctgttgccaaagggcgatcccgaaagaagaagactgctgagcattgtcgtggtgggcggagggcctacaggtgtggaagccgctggcgagctgcaggactacgtgcaccaggacctgcggaagttcctgcccgccctggccgaggaagtgcagattcacttggtggaagccctgcccatcgtgctgaacatgttcgagaaaaagctttcatcatacgcccagagccatttagaaaacacttccatcaaagtacacctgagaaccgccgtggccaaggtggaagagaagcagctgctggccaagaccaaacacgaggacggtaagattaccgaagaaaccatcccatacggcactttgatttgggccaccggtaacaaggccagaccggtgatcacagacctgttcaagaagatccccgagcagaacagctccaagagaggcttggcagtgaacgactttctgcaggtcaaaggcagcaacaacatcttcgccattggcgacaacgcctttgccgggctgccacctacagcccaagtggcgcaccaggaggccgagtacttggccaagaatttcgacaagatggcccaaataccaaatttccagaagaacctatcttcaagaaaggataaaattgacctcctgttcgaggagaacaactttaaacctttcaagtacaacgacctgggcgccctggcctacctgggcagcgaaagggccattgcaaccatcagaagcggtaagagaacattctacaccggtggtggcttaatgaccttctacttatggagaatcctgtacctgagcatgattctaagcgcaagatcgagactgaaggtcttcttcgactggatcaaactggcattcttcaaaagggacttcttcaagggcctgtga

SEQ ID NO: 910 - DNA, 1542 bp, Artificial Sequence
  source: /note="Description of Artificial Sequence: Synthetic polynucleotide"
atgctgtcgaagaacctgtatagcaacaagcggctgctgaccagcaccaacacgctcgtccgcttcgcctccaccagatccaccggggtggaaaacagcggagctggccccacctcttttaagaccatgaaaatcattgacccccagcacagcgacaaacccaacgtgctgatcctgggctctggctggggagccattagctttttaaagcacattgacaccaagaagtacaacgtctccatcgtgagccccagaagctacttcttattcacccccttgctgccctctgcccctgttggaacagtggacgaaaagtccatcatcgagcccatcgttaacttcgccctgaagaaaaaggggaacgttacctactatgaggccgaggccaccagcatcaatcccgacaggaacaccgtgaccatcaagagcctgtctgccgttagccagctataccaacccgagaaccacctagggctgcaccaagccgaacccgctgagattaagtacgactacctgatcagtgccgtaggtgccgagcccaacacctttggaattcctggggtgactgactacggtcatttcctgaaggagattcccaactctctggaaatcagacggactttcgccgccaacctggaaaaggctaacctgttgcctaagggtgatcccgagagaagaagactgctgagcatcgtcgtcgttggcggtgggcccacaggtgtggaggccgctggcgagctgcaggactacgttcaccaggacctgagaaagtttctccccgccctggccgaggaagtgcagattcacttggtcgaagccctgcccatcgtgttgaacatgttcgagaagaagctttcatcatacgcccaaagccacctggaaaacacctcgatcaaagtacacctgagaaccgccgtggccaaagttgaagagaagcagctgctggccaagaccaaacacgaagacggcaagattaccgaagaaaccatcccctacggcactctgatttgggccaccggcaacaaggcaagacccgtgatcaccgacctgttcaagaagatccccgagcagaactcgagcaagagaggcctggcagtgaacgacttcctgcaggtgaaaggcagcaacaacattttcgccatcggtgacaatgcatttgctgggttgcctcctacagcccaggtggcccaccaggaggccgaatacttggccaagaacttcgataagatggctcaaatcccaaatttccaaaagaacctgtcctcacggaaggataagatcgatctcctgttcgaggaaaacaacttcaaacccttcaagtacaacgacctgggcgccttagcctacctgggaagcgaaagagccattgccaccatacgtagcggtaagcggaccttctacaccggtggaggcttaatgaccttctacctgtggcggattttgtacctgagcatgatcctaagcgcacgctcgagactgaaggtcttcttcgactggatcaaattagcctttttcaaaagggactttttcaagggactgtga

SEQ ID NO: 911 - DNA, 1542 bp, Artificial Sequence
  source: /note="Description of Artificial Sequence: Synthetic polynucleotide"
atgctaagcaagaatctgtacagcaacaagcggctgctgacctcgaccaataccctagtgagattcgctagcaccagatccaccggggtggaaaacagcggagctggtcccaccagcttcaagaccatgaagatcatcgacccccagcacagcgacaagccaaacgtgctgatcctgggctcggggtggggcgccattagctttctgaagcacatcgacaccaagaagtacaacgttagcatcgtgtctcctagaagctatttcctgttcacgcccctgctgccctctgccccagttggaaccgtagacgagaagtccattatcgagcccatcgtgaattttgccctcaagaaaaaggggaacgtcacctactatgaggcagaagccaccagcatcaatcccgacaggaacaccgttaccataaagtcactgagcgccgtttcccagctataccaacccgagaaccatctaggcctgcaccaagcagagcccgccgaaattaagtacgactatctgatcagcgccgtaggcgccgagcccaacacctttggaattcctggggtcaccgactacggccacttcctgaaagagatccccaacagcctggaaatccggagaactttcgccgccaatctggaaaaggccaacttactgcctaagggtgatcccgaacggagaagactactgagcatcgtcgtggttggcggtgggcctactggcgtggaagctgctggcgagctacaggattacgtgcaccaggacctgcggaagtttctccctgcactggccgaagaagtgcagattcacctggtggaagccctgcccatcgtgctgaacatgttcgagaagaagcttagcagctacgcccagtcacacttagaaaacacttcgatcaaggtgcatctgagaaccgctgtggccaaggttgaagagaagcagctgctggccaagacgaagcacgaggacggcaaaattaccgaggaaaccatcccatacggcaccctgatttgggccaccggcaacaaggccagacccgtgatcaccgacctgttcaagaagatccccgagcagaacagctccaagagaggcttggcagtgaatgacttcctgcaggtcaaaggcagcaacaacatcttcgccatcggcgacaacgcctttgctggcttgccaccaacagcccaggtggcgcaccaagaagccgagtacctggccaagaattttgataagatggctcaaatacccaatttccagaagaatctgtcctcaagaaaggataagatcgacctcttgttcgaggagaacaacttcaaacccttcaagtacaacgatctgggcgccttagcctacctgggaagcgaaagggccattgccaccataagaagcggtaagcggacattctacaccggtggaggcttaatgaccttctacctgtggagaatcctgtacttgagcatgatcctatctgcaagatcgagactgaaggtcttcttcgactggattaaactggccttcttcaagagggactttttcaagggcttatga

SEQ ID NO: 912 - DNA, 1542 bp, Artificial Sequence
  source: /note="Description of Artificial Sequence: Synthetic polynucleotide"
atgctgagcaagaacctgtacagtaacaagaggctgctgacctcgacgaacacgctagtgagattcgccagcaccagatccacaggggtcgaaaactccggggcaggccccacaagctttaagaccatgaaagtcattgacccccagcacagcgacaaaccaaacgtgctgatcctgggttctgggtggggcgctatttcgtttctgaagcacatcgacaccaagaagtacaacgtcagcatcgtgagccccagaagctacttcctgttcacccctttgttacccagcgcccctgtgggaaccgtggacgagaagtccatcatcgagcccatcgtgaactttgccctcaagaaaaagggcaacgtcacctactatgaggccgaggccaccagcatcaaccccgaccggaacaccgttaccatcaaatcactgagcgccgtttcccagctgtaccaacctgagaaccatctgggcctgcaccaagccgagcccgccgagattaagtacgattatttaatcagtgccgtgggcgccgaacccaacacatttggaattcctggcgtgaccgactacggtcacttcctgaaagagatccccaacagcttggaaataagacggaccttcgccgccaacctggaaaaggccaacttactgccaaagggcgatcccgagcggagaaggctgctgagcattgtcgtcgttggcggtggccctactggtgtagaagccgctggcgaactgcaggattatgtgcaccaggacctgcggaagttcctccctgcactggccgaggaagtccagattcacctggtggaagccctgcccatcgtgctgaatatgttcgagaagaagctgagctcatacgcccaatcacatctggaaaacacttcgatcaaagtgcacctgagaacggctgtcgccaaagtggaagagaagcaactgctggcaaagaccaagcacgaagacggcaaaattaccgaagaaactatcccatacggtactttgatttgggccaccggtaacaaggccagacccgtgatcaccgacctgttcaagaagatccctgagcagaacagctccaagagaggcctggccgtgaatgactttttgcaggtgaaaggcagcaacaacatcttcgccatcggtgacaatgcatttgctggcttgcctcctacagcccaggtggcccaccaggaggccgaatatctggccaagaacttcgacaagatggcccaaatccccaatttccaaaagaacctatcttcaagaaaggataaaatcgacctgctgttcgaggaaaacaacttcaagcccttcaaatacaacgacctgggtgccctggcctacctgggatccgaaagagccattgcaaccatcagaagcggcaagcggacattctacaccggtggaggcttaatgaccttctacttatggcggattatctacctgagcatgatcctaagcgcaagaagcagattaaaggtgttcttcgactggatcaaactggccttcttcaaaagagacttctttaagggcctgtga

SEQ ID NO: 913 - DNA, 1542 bp, Artificial Sequence
  source: /note="Description of Artificial Sequence: Synthetic polynucleotide"
atgctgtcgaagaacttgtatagtaacaagcggctgctcaccagcacgaataccctcgtccgcttcgcttccaccagatccaccggcgtcgaaaacagcggggctggccccacctcttttaagaccatgaagatcatcgacccccagcacagcgacaagccaaacgtgctgatactgggctctgggtggggcgccatcagctttttaaagcacattgacaccaagaagtacaacgtttccatcatcagccccagaagctatttcatctttacgcccctgttacccagcgcccctgtgggaaccgtagacgagaagtccatcatcgagcccatcgttaacttcgctctgaagaaaaaggggaacgtcacctactacgaggccgaggccaccagcatcaaccccgaccggaataccgttaccatcaaatcactgagcgccgtgagccagctgtaccaacccgaaaaccatctagggctgcaccaggccgaacccgccgagattaagtacgattacttaatcagcgctgtgggtgcggaacctaacacctttggaattcctggggtcaccgattacggccatttcctgaaagaaatccccaacagcttggaaatccggagaactttcgccgccaacctggaaaaggccaacttactgccaaagggtgatcccgagagaagaaggctgctgagcatcgtggtcgtgggcggaggccctactggcgtagaggctgctggcgaactgcaggactatgttcaccaggacctgagaaagttcctccccgccctggccgaagaagtgcagattcacttggtggaagccctgcccatcgtgctgaacatgtttgagaaaaagctgtcatcatacgcgcaaagccatttagaaaacacctccatcaaggtacacctgagaacggccgtggccaaagtggaagaaaagcagttgttggcaaagaccaaacacgaagacggcaagataaccgaagaaaccatcccctacggcaccttgatttgggccaccggcaacaaggccagaccggtgatcaccgacctgttcaagaagattcccgagcagaacagctccaagcggggcctggccgtgaacgacttcctgcaagtcaaaggcagcaacaacattttcgccattggcgacaacgcctttgccggcttgcctcctacagcccaggtggcccaccaggaagccgaatacctggccaagaactttgacaaaatggctcagatccccaatttccagaagaacctgtcctccagaaaggataaaattgatctcctgttcgaggagaacaactttaaacccttcaaatacaacgacttaggcgccctggcctacctgggctccgaaagagccattgccaccatcagatccggcaagcggacattctacaccggtggtggcctgatgaccttctacttatggcggatcctgtacctgtccatgattctatctgcccgcagcagattaaaggtcttcttcgactggatcaagttagcatttttcaagagagacttttttaagggcctgtga

SEQ ID NO: 914 - DNA, 1542 bp, Artificial Sequence
  source: /note="Description of Artificial Sequence: Synthetic polynucleotide"
atgctgagcaagaacctgtacagcaacaagaggctgctgaccagcacgaacaccctcgtccgcttcgcctccaccagatccaccggcgtggaaaacagcggagctggccccacatcttttaagaccatgaaggtcatcgacccccagcacagcgacaagccaaacgtgctgatactgggttctgggtggggagccatcagctttctgaagcacattgacaccaagaagtacaacgtctccatcatcagccccagaagctatttcctgttcacgcccctgctgccctctgcaccagtgggaaccgtggacgagaagtcaatcatcgagcccatcgttaactttgccctcaagaaaaagggcaacgtcacctactacgaggccgaagccaccagcatcaaccccgacaggaacaccgttaccataaaaagcttatctgccgtttcccagctataccagcctgagaaccatctgggcctgcatcaggcagaacctgctgagattaagtacgactacttaatcagcgccgtgggcgcggaacctaacacctttggtatccccggggtcaccgactacggtcacttcctgaaagaaatccccaacagcctggaaatcagaagaacttttgccgccaacctggagaaggccaacctgctgccaaagggcgaccccgaacggagaaggctactgagcattgtcgtggttggcggtgggcccacaggcgtagaggctgctggcgaactacaggactatgtgcaccaggacctgcggaagttcctgcccgccctggccgaggaaatccagattcacctggtcgaagctctgcccatcgttttgaatatgtttgagaagaagcttagctcatacgcccaatcacacttagaaaacacctccatcaaggtacacctgagaaccgctgtggccaaggtggaagaaaagcagttgctggccaagaccaagcacgaagacggcaagattaccgaggaaaccattccctacggcaccctgatttgggccacgggcaacaaggccagaccggtgatcaccgacctgttcaagaagatccctgagcaaaactcgtccaagcggggcctggcagtgaacgacttcctgcaggtgaaaggcagcaacaacatcttcgccatcggcgacaacgcctttgctgggttgcctccaaccgcccaggtggcccaccaggaggccgaatacttggccaagaattttgacaagatggcccaaatacccaatttccaaaagaatctatcctcacggaaggataagattgacctcctgttcgaggaaaacaacttcaagcctttcaagtacaacgatctgggcgccttagcctacctgggatccgaaagagccattgcaaccatccgtagcggcaagagaaccttctacaccggcggaggcttaatgaccttctacttatggcggatcatctacttgagcatgattctgtctgcccgctcgagactgaaggtctttttcgactggatcaagctggccttcttcaagagggacttcttcaagggcttatag

SEQ ID NO: 915 - DNA, 1542 bp, Artificial Sequence
  source: /note="Description of Artificial Sequence: Synthetic polynucleotide"
atgctatcgaagaacttgtatagcaacaagaggctgctcaccagcacgaacaccctcgtgcgcttcgccagcaccagatccacaggcgtcgaaaactccggggcaggtcctaccagcttcaagaccatgaaggtcattgacccccagcacagcgacaaacccaacgtgctgatactgggctctggctggggagccatctcgtttttaaagcacatcgacaccaagaagtacaacgtttccatcatcagccctagaagctacttcatcttcacgcccctgttacctagcgcccctgttggaacagtggacgagaagtccatcatcgagcccatcgtgaatttcgctctcaagaaaaagggcaacgttacctactatgaggcagaagccaccagcatcaatcccgaccggaataccgttaccatcaagtcattaagcgccgtgagccagctgtaccagcccgaaaaccatctagggctgcatcaggccgaacccgccgagattaagtacgactatctgatcagcgctgtaggtgccgaacccaacacatttggtatccctggcgtcaccgattacggccatttcctgaaggagattcccaacagcctggaaatccggcggacttttgccgccaacctggaaaaggctaacctgctgcctaagggcgaccccgagagaagaaggctactgagcatcgtcgtcgtgggcggaggccctactggcgtagaagctgctggcgagctacaggattacgttcaccaggacctgcggaagttcctgcccgccctggccgaggaagtccagattcacttggtggaagccctgcccatcgtgctgaatatgtttgagaaaaagctgtcaagctacgcccagagccatctggaaaacacctccatcaaagtgcacctgagaaccgccgtcgccaaagttgaagagaagcaactgctggcaaagaccaaacacgaggacggcaagattaccgaggaaaccatcccctacggcaccctgatttgggccaccggcaacaaggccagacccgtaatcaccgacctgttcaagaaaatccccgagcaaaacagcagcaagcggggcttggccgtgaacgacttcttgcaggtcaaaggcagcaacaacatcttcgccatcggtgacaacgcatttgccggcttgccaccaacagcccaggtggcccaccaagaagccgaatatttggccaagaacttcgacaagatggcccagatccccaatttccaaaagaatctatcctcaagaaaggataagatcgatctgttgttcgaggagaacaacttcaaacccttcaaatacaacgacctgggcgccttagcatacctgggcagcgaaagagccattgcaaccatacgtagcggtaagcggaccttttacaccggtggaggcctgatgaccttctacttatggagaatcatctacatgtccatgattctgtctgcacgcagcagattaaaggtgttcttcgactggattaagctggcattcttcaagagggacttcttcaaaggattatga

SEQ ID NO: 916 - DNA, 1542 bp, Artificial Sequence
  source: /note="Description of Artificial Sequence: Synthetic polynucleotide"
atgctgagcaagaatttgtacagtaacaagcggctgctcaccagcaccaacaccctagtgagattcgctagcaccagatccaccggcgtcgaaaacagcggggcaggtcccacaagcttcaagaccatgaaggtcattgaccctcagcacagcgacaaaccaaacgtgctgatactgggctctggctggggcgctattagctttctgaagcacatcgacaccaagaagtacaacgtcagcatcgtgagccccagaagctacttcttatacacgcccctgctgcccagcgcccctgttgggaccgtagacgagaagtcaatcattgagcccatcgtgaacttcgctctgaagaaaaagggcaacgtcacctactatgaggccgaggccaccagcatcaaccccgaccggaataccgtgaccataaaatcactgagcgccgtgagccagctgtaccagcctgaaaaccacctagggctgcaccaggccgaacctgctgaaattaagtacgactacctgatcagcgccgtaggcgcggaacctaacacctttggaatccccggggtgactgactacggccatttcctgaaagaaatccccaacagcctggaaatacggagaacctttgccgccaatctggaaaaggccaacctgttgcctaagggtgaccccgaaagaagaaggctactgagcatcgtcgtggtgggcggtggccccactggcgtggaggccgctggcgagctgcaggactacgttcaccaggacctgagaaagtttctccccgcattggccgaagaaatccagattcacctggtggaagccctgcccatcgtgctgaacatgtttgagaaaaagcttagctcatacgcgcaatcacacttagaaaacacctccatcaaagtacacctgagaacggccgtcgccaaggttgaagagaagcaattgttggccaagaccaagcacgaggacggcaagattaccgaggaaaccatcccctacggcaccctgatttgggccaccggcaacaaggcaagaccggtgatcaccgacctgttcaagaagatccctgagcaaaacagcagcaagcggggcttggcagtgaatgacttcctgcaggtgaaaggcagcaacaacatcttcgccattggcgacaacgcatttgctggcctgccacctaccgcccaggtggcgcaccaggaagccgagtatctggccaagaacttcgacaaaatggctcagatacccaatttccagaagaacctgtcctcacggaaggataagattgacctgttgttcgaggaaaacaactttaaacctttcaaatacaacgatctgggcgccttagcatacctgggatccgaaagagccattgccaccataagaagcggcaagcggacattttacaccggcggaggcctgatgaccttctacttatggcggatcttgtacctgtccatgattctaagcgccagatcgagactgaaggtgttcttcgactggattaagttagcctttttcaaaagggacttcttcaagggcctgtag

SEQ ID NO: 917 - DNA, 1542 bp, Artificial Sequence
  source: /note="Description of Artificial Sequence: Synthetic polynucleotide"
atgctgagcaagaatctgtacagcaacaagcggttgctcaccagcaccaacacgctcgtgcgcttcgcctccaccagatccaccggcgtcgaaaacagcggggcaggccccacatcttttaagaccatgaaggtcattgacccccagcacagcgacaagcccaacgtgctgatactgggctctgggtggggagctatctcgtttttaaagcacatcgacaccaagaagtacaacgtcagcatcgtgagccccagaagctatttcctgtacacgcctctgttacccagcgcacctgtggggaccgtggacgagaagtccattattgagcccatcgtgaatttcgccctgaagaaaaagggcaacgtcacctactacgaggccgaggccaccagcatcaatcccgacaggaacaccgttaccataaagtcactgtctgccgtgagccagctataccagcccgagaaccatctagggctgcatcaagccgaacccgctgagattaagtacgattacctgatcagcgctgtgggcgcggaacccaacacatttggaatccccggcgtcaccgactacggtcacttcctgaaggagatccccaacagcttggaaatcagacggacctttgccgccaatctggagaaggctaacctgctgccaaagggcgaccccgagcggagaaggctgctgagcatcgtcgtggtgggtggtggccctactggcgtggaggctgctggcgaactgcaggactacgttcaccaggacctgcggaagtttctccccgccctggccgaagaagtgcagattcacctggtggaagccctgcccatcgtgctgaacatgtttgagaaaaagcttagcagctacgcgcaaagccatctggaaaacacctccatcaaagtacacctgagaaccgctgtcgccaaggtggaagaaaagcaactgttggcaaagaccaagcacgaggacggcaaaattaccgaggaaaccatcccatacggcactttgatttgggccaccggcaacaaggccagaccggtaatcacagacctgttcaagaagatccccgagcaaaacagcagcaagcggggattggccgtgaatgacttcctgcaagtcaaaggcagcaacaacatcttcgccattggtgacaatgcctttgccggcctgcctcctacagcccaggtggcgcaccaggaggccgaatacctggccaagaatttcgataaaatggcccaaatccccaatttccaaaagaacctgtcctccagaaaggataaaatcgacctcctgttcgaggagaacaactttaaacccttcaaatacaacgatttaggcgccctggcatacctgggctccgaaagagccattgccaccatccgttccggcaagagaacattttacaccggcggtggcctgatgaccttctacttatggcggatcttgtacatgagcatgattctgtctgcacgcagcagactgaaggtgtttttcgactggatcaagctggcatttttcaagagagacttcttcaagggcctgtga

SEQ ID NO: 918 - DNA, 1542 bp, Artificial Sequence
  source: /note="Description of Artificial Sequence: Synthetic polynucleotide"
atgctgtcgaagaatctgtacagcaacaagcggctgctcaccagcaccaataccctcgtgagattcgcttccaccagatccaccggcgtcgaaaactccggagctggtcccacatctttcaagaccatgaaaatcatcgacccccagcacagcgacaagcccaacgtgctgatactgggctcgggctggggcgccatctcgtttttaaagcacatcgacaccaagaagtacaacgtctccatcatctctcccagaagctacttcatctttacccccctgctgcctagcgcccctgttggaacagtggacgagaagtcaatcattgagcccatcgtgaacttcgctctgaagaaaaaggggaacgttacctactacgaggccgaagccaccagcatcaatcccgaccggaataccgttaccatcaagagcctgagcgccgttagccagctgtaccaacctgaaaaccacctggggctgcatcaagccgaacccgccgaaattaagtacgattacctgatcagtgccgtaggtgccgagcccaacacctttggaattcctggcgtgaccgactacggccacttcctgaaagaaattcccaacagcctggaaataagacggactttcgccgccaacctagaaaaggctaacctgttgcctaagggcgaccccgagagaagaaggctgctgagcatcgtggtcgtgggcggtggccccacaggcgtggaagctgctggtgaactgcaggactacgttcaccaggacctgagaaagttcctccccgccctggccgaggaaatccaaattcacctggtggaagctctgcccatcgttctgaacatgtttgagaagaagctgagcagctacgcgcagagccacttagaaaacacctccatcaaggtgcatctgagaacggctgtggccaaggttgaagagaagcagctgctggccaagacgaaacacgaggacggcaaaattaccgaggaaactatcccctacggtaccctgatttgggccaccggtaacaaggcaagaccggtgatcaccgaccttttcaagaaaattcctgagcaaaactcgagcaagcggggcctggcagtgaacgacttcttgcaggtgaaaggcagcaacaacatcttcgccatcggtgacaacgcctttgctgggctgccacctaccgcccaggtggcccaccaagaggccgagtatttggccaagaattttgacaaaatggcccagataccaaatttccagaagaatctatcctccagaaaggataagattgacctgctgttcgaggaaaacaacttcaaacctttcaagtacaacgatctgggtgccctggcatacctgggctccgaaagggccattgccaccatccgttccggcaagcggaccttctacaccggcggtggcctgatgaccttctacctgtggcggattctgtacctgagcatgatcctgagcgcccgcagcagattaaaggtcttcttcgactggattaagctggcattcttcaaaagagactttttcaagggactgtag

SEQ ID NO: 919 - DNA, 1542 bp, Artificial Sequence
  source: /note="Description of Artificial Sequence: Synthetic polynucleotide"
atgctgagcaagaacctgtatagcaacaagaggttgctcaccagcaccaacaccctcgtcagattcgccagcaccagatccaccggcgtcgaaaacagcggagctggccccacaagctttaagaccatgaaagtcatcgacccccagcacagcgacaagccaaacgtgctgatactgggttcggggtggggcgctatctcgtttctgaagcacatcgacaccaagaagtacaacgtttccatcgtgagccctagaagctatttcttatacacccccctgctgcctagcgcccctgtggggacagtggacgagaagtccatcattgagcccatcgttaacttcgccctgaagaaaaagggcaacgtcacctactatgaggccgaggccaccagcatcaaccccgaccggaacaccgttaccatcaagagcttatctgccgtgagccagctataccaacccgagaaccacctgggcctgcatcaagccgagcctgccgagattaagtacgactatttaatcagcgccgtgggtgcggagcctaacacctttggaatccctggggtgactgactacggccacttcctgaaggaaatccccaactctttggaaatacggagaaccttcgccgccaacctggaaaaggccaacctgttgccaaagggtgaccccgagcggagaaggctgctgtccatcgtggtcgtgggcggagggcccactggcgtagaggccgctggtgagctgcaggactacgtgcaccaggacctgcggaagtttctccctgccctggccgaggaagtccaaattcacctggtggaagccctgcccatcgttctgaatatgttcgagaagaagctgtcaagctacgcgcaaagccacttagaaaacacctccatcaaggtgcacctgagaaccgccgtcgccaaggtggaagagaagcaactgttggccaagacgaagcacgaagacggcaaaattaccgaagaaactattccctacggcaccttgatttgggccacgggtaacaaggccagacccgtaatcacagaccttttcaagaaaattcccgagcagaactcgagcaagcggggactggccgtgaatgacttcttgcaagtcaaaggcagcaacaacattttcgccatcggcgacaatgcctttgccggcctgccaccaaccgcccaggtggcccaccaagaggccgagtacttggccaagaatttcgacaaaatggcccaaatccccaatttccagaagaatctgtcttccagaaaggataagattgacctgctgttcgaggaaaacaactttaagcctttcaagtacaacgacttaggcgccttagcctacctgggctccgaaagagccattgccaccatccgtagcggcaagagaacattttacaccggtggaggcttaatgaccttctacctgtggagaatcctgtacatgagcatgatcctgagcgcccgctcgagattaaaggtgtttttcgactggatcaaattagcctttttcaagagggacttcttcaaaggattatga

SEQ ID NO: 920 - DNA, 1542 bp, Artificial Sequence
  source: /note="Description of Artificial Sequence: Synthetic polynucleotide"
atgctgagcaagaacctgtatagcaacaagcggctgctgaccagcaccaacacgctagtgcgcttcgctagcaccagatccacaggggtggaaaacagcggggctggtcccacatctttcaagaccatgaagatcatcgacccccagcacagcgacaagcccaacgtgctgatactgggctctgggtggggcgctatctcgtttctgaagcacattgacaccaagaagtacaacgttagcatcatcagccctagaagctacttcttattcacccccctgttaccctctgcccctgtgggaacagtggacgaaaagtcaattatcgagcccatcgttaattttgctctcaagaaaaaggggaacgtcacctactatgaggccgaggccacctctatcaaccccgaccggaacaccgttaccatcaagtcattatctgccgttagccagctgtaccagcccgaaaaccatctggggctgcatcaggccgagcccgctgagattaagtacgattatttaatcagtgccgtaggtgcggaacccaacacatttggaatccccggcgtgactgactacggccacttcctgaaggagattcccaacagcttggaaatcagacggaccttcgccgccaatctggagaaggccaacctgctgcctaagggtgaccccgaaagaagaagactgctgagcatcgtggtggtgggtggaggccctactggcgtggaagctgctggcgagctgcaggactacgtgcaccaggacctgagaaagttcctccccgcattggccgaagaagtgcagattcacctggtcgaagctctgcccatcgtgttgaatatgttcgagaagaagctgtcatcatacgcccagagccacctggaaaacacctcgatcaaggtacacctgagaaccgccgtggccaaagtggaagaaaagcaattgttggcaaagaccaaacacgaggacggcaaaattaccgaggaaaccatcccctacggcactctgatttgggccacgggcaacaaggccagaccggtaatcaccgacctgttcaagaaaatccccgagcaaaacagctccaagcggggcctggcagtgaatgactttctgcaggtcaaaggcagcaacaacatcttcgccattggcgacaacgcatttgctggcctgcctcctacagcccaggtggcccaccaggaggccgaatatttggccaagaactttgacaaaatggcccaaatcccaaatttccagaagaatctatcctcacggaaggataagattgacctgctgttcgaggagaacaactttaagcctttcaaatacaacgacctgggcgccctggcctacctgggcagcgaaagagccattgccaccatccgtagcggcaagcggaccttttacaccggcggtggcctgatgaccttctacttatggcggatcatctacatgagcatgatcctgtctgccagatcgagattaaaggtgttcttcgactggatcaagctggcattcttcaagagggactttttcaaaggactgtga

SEQ ID NO: 921 - DNA, 1542 bp, Artificial Sequence
  source: /note="Description of Artificial Sequence: Synthetic polynucleotide"
atgctgagcaagaacctgtatagcaacaagcggttgctgaccagcaccaacacgctagtcagattcgcttccaccagatccaccggggtcgaaaacagcggggctggccctaccagcttcaagaccatgaagatcatcgacccccagcacagcgacaagcccaacgtgctgatactgggttctggctggggagctatcagctttttaaagcacattgacaccaagaagtacaacgttagcatcatcagccctagaagctacttcctgttcacccccttgctgcctagcgccccagtgggaacagtagacgagaagtccatcatcgagcccatcgtgaactttgccctcaagaaaaaggggaacgttacctactacgaggccgaagccacctctatcaatcccgacaggaacaccgtgaccataaaatcactgagcgccgtttcccagctgtaccaacctgagaaccacctgggcctgcatcaggccgagcccgctgagattaagtacgactacctgatcagcgctgtaggcgcggagcctaacacctttggaattcctggcgtgaccgattacggccacttcctgaaagagattcccaactctctggaaatcagaagaaccttcgccgccaatctggagaaggccaacttattgcctaagggcgaccccgagcggagaagactgctgagcatcgtcgtcgtgggcggaggccccacaggtgtagaggctgctggtgagctacaggattatgtgcaccaggacctgagaaagttcctgcctgccttggccgaagaaatccagattcacctggtcgaagccctgcccatcgttttgaacatgttcgagaagaagctttcaagctacgcgcagagccatctggaaaacacctccatcaaagtacacctgagaaccgctgtggccaaggttgaagagaagcagctgctggcaaagaccaaacacgaagacggcaagattaccgaggaaactatcccctacggcactttgatttgggccacgggtaacaaggccagacccgtgatcacagacctgttcaagaagatccccgagcaaaacagcagcaagcggggattggccgtgaacgacttcctgcaggtcaaaggcagcaacaacattttcgccattggcgacaatgcctttgccgggctgcctcctaccgcccaggtggcccaccaggaggccgagtacctggccaagaatttcgataagatggctcagatcccaaatttccagaagaacctatcctccagaaaggataaaatcgatctcttgttcgaggaaaacaactttaaacccttcaaatacaacgacctgggtgccctggcatacctgggcagcgaaagggccattgccaccataagatccggtaagcggaccttctacaccggtggaggcttaatgaccttctacctgtggagaatcatctacctgtccatgattctgagcgcacgcagcagactgaaggtcttcttcgactggattaaattagcatttttcaaaagagacttcttcaagggcctgtga

SEQ ID NO: 922 - DNA, 1542 bp, Artificial Sequence
  source: /note="Description of Artificial Sequence: Synthetic polynucleotide"
atgctaagcaagaatctgtacagcaacaagcggctgctcaccagcaccaacacgctcgtgagattcgcttccaccagatccaccggggtcgaaaacagcggagcaggccccaccagcttcaagaccatgaaggtcattgacccccagcacagcgacaagcccaacgtgctgatactgggttctgggtggggagccatcagctttctgaagcacatcgacaccaagaagtacaacgtctccatcatctctcctagaagctatttcatctacacccctctgctgccctctgcacctgtgggaacagtggacgagaagtccatcatcgagcccatcgttaactttgccctcaagaaaaagggcaacgttacctactatgaggcagaagccaccagcatcaaccccgaccggaataccgttaccatcaagtcactgtctgccgtgtcccagctgtaccagcctgaaaaccatctgggcctgcaccaggccgagcctgccgaaattaagtacgactatctgatcagcgccgtgggcgccgagcctaacacatttggtattcctggcgtcaccgattacggccatttcctgaaagaaattcccaacagcctggaaatcagacggaccttcgccgccaacctagagaaggccaacttattgccaaagggcgaccccgagagaagaaggctactgagcattgtggtcgtgggtggaggccccacaggcgtggaggctgctggcgagctgcaggactatgtgcaccaggacctgagaaagttcctgcctgcactggccgaggaaatccaaattcacctggtggaagccctgcccatcgtgctgaacatgtttgagaagaagctgagcagctacgcccagagccacttagaaaacacctcgatcaaggtgcatctgagaaccgccgtcgccaaagttgaagaaaagcagttgttggcaaagaccaaacacgaggacggtaaaattaccgaggaaactatcccctacggcactctgatttgggccacgggcaacaaggccagacccgtgatcacagaccttttcaagaaaatccccgagcagaactcgagcaagcggggcctggcagtgaatgactttttgcaagtgaaaggcagcaacaacatcttcgccatcggtgacaatgcctttgctggcctgccaccaacagcccaggtggcccaccaagaagccgagtacctggccaagaattttgacaaaatggctcaaatacccaatttccagaagaacctgtcctccagaaaggataagattgacctgttgttcgaggagaacaactttaagcctttcaagtacaacgatttaggtgccttagcctacctgggcagcgaaagagccattgcaaccataagaagcggcaagagaacattctacaccggcggaggcctgatgaccttctacttatggcggatcctgtacctgtccatgatcctgagcgcccgctcgagattaaaggtgttcttcgactggatcaagttagcattcttcaaaagggacttctttaaaggcctgtga

SEQ ID NO: 923 - DNA, 1542 bp, Artificial Sequence
  source: /note="Description of Artificial Sequence: Synthetic polynucleotide"
atgctgagcaagaacttgtacagcaacaagcggctgctgacctcgaccaataccctcgtgcgcttcgccagcaccagatccacaggcgtcgaaaactccggggctggccccacctctttcaagaccatgaaaatcattgacccccagcacagcgacaaacccaacgtgctgatcctgggctcggggtggggcgccatctcgtttctgaagcacatcgacaccaagaagtacaacgtcagcatcgtgtctcctagaagctatttcctgttcacgcctctgttacccagcgcaccagtgggaacagtagacgaaaagtccattatcgagcccatcgttaactttgccctgaagaaaaagggcaacgtcacctactacgaggccgaggccaccagcatcaaccccgaccggaataccgtgaccataaaaagcttatctgccgtttcccagctataccagcctgagaaccacctgggcctgcaccaggcagaacccgccgaaattaagtacgactacctgatcagcgctgtaggcgcggaacccaacacatttggtattcctggcgtcaccgattacggccacttcctgaaagagatccccaacagcctggaaatccggcggaccttcgccgccaacctagaaaaggctaacctgctgcctaagggcgaccccgagagaagaaggctgctgagcatcgtcgtcgtgggcggagggcctactggcgtagaggctgctggcgaactgcaggactatgtgcaccaggacctgcggaagtttctccccgcactggccgaggaagtccaaattcacttggtggaagctctgcccatcgttttgaatatgtttgagaagaagctgagctcatacgcccagagccacttagaaaacacctcgatcaaggtacacctgagaaccgctgtggccaaagtggaagaaaagcagttgctggccaagaccaagcacgaagacggcaagattaccgaagaaactatcccatacggtactctgatttgggccaccggcaacaaggcaagacccgtgatcaccgaccttttcaagaaaatccccgagcagaactcgagcaagagaggactggccgtgaacgacttcttgcaagtgaaaggcagcaacaacatcttcgccatcggtgacaatgcctttgccggcttgccacctacagcccaggtggcccaccaggaggccgaatacttggccaagaacttcgacaaaatggcccaaatacccaatttccagaagaatctatcctcaagaaaggataagatcgacctgctgttcgaggaaaacaactttaagcccttcaagtacaacgatttaggtgccttagcatacctgggctccgaaagagccattgccaccatacgttccggcaagcggacattctacaccggcggaggcctgatgaccttctacctgtggcggatcttgtacatgtccatgattctatctgcaagaagcagactgaaggtgttcttcgactggatcaaactggccttcttcaagagggacttttttaagggattatag

SEQ ID NO: 924 - DNA, 1542 bp, Artificial Sequence
  source: /note="Description of Artificial Sequence: Synthetic polynucleotide"
atgctgagcaagaacttgtatagcaacaagcggttgctcaccagcacgaacacgctcgtgcgcttcgcctccaccagatccaccggggtggaaaacagcggggcaggccccaccagctttaagaccatgaaggtcatcgaccctcagcacagcgacaagcccaacgtgctgatcctgggctctgggtggggcgccatctcgtttttaaagcacattgacaccaagaagtacaacgtttccatcatcagccccagaagctatttcatctacacccccctgctgcctagcgccccagttggaacagtagacgaaaagtccattattgagcccatcgtgaactttgctctcaagaaaaagggcaacgtcacctactatgaggccgaagccaccagcatcaatcccgaccggaataccgtgaccataaagagcctgagcgccgttagccagctgtaccaacccgagaaccatctgggcctgcaccaggccgaacccgctgaaattaagtacgactacctgatcagcgctgtaggtgccgagcccaacacctttggaattcccggcgtcaccgattacggtcacttcctgaaagagattcccaacagcttggaaatccggcggacctttgccgccaacctggagaaggccaacctgctgccaaagggcgatcccgagagaagaaggctgctgagcatcgtggtggttggcggaggccccactggcgtggaagccgctggcgaactacaggactacgtgcaccaggacctgcggaagttcctgcccgccttggccgaagaagtccaaattcacttggtggaagccctgcccatcgttttgaacatgttcgagaaaaagctgagcagctacgcgcagagccatctggaaaacacctccatcaaagtacacctgagaaccgccgtcgccaaggtggaagaaaagcaactgttggccaagacgaagcacgaagacggcaaaataaccgaagaaactatcccctacggtaccctgatttgggccaccggtaacaaggcaagacccgtgatcaccgaccttttcaagaaaatccctgagcagaacagctccaagcggggattggcagtgaacgacttcctgcaggtgaaaggcagcaacaacattttcgccatcggtgacaatgcatttgccggcctgccaccaaccgcccaggtggcccaccaagaagccgagtatctggccaagaactttgataagatggctcagataccaaatttccagaagaacctgtcctcaagaaaggataaaattgatctgctgttcgaggagaacaactttaagcccttcaaatacaacgacctgggtgccctggcctacctgggcagcgaaagagccattgccaccatcagaagcggtaagcggacattctacaccggcggtggcctgatgaccttctacctgtggagaattctgtacatgagcatgatcctgtctgcacgctcgagattaaaggtgtttttcgactggatcaaactggccttcttcaagagggacttctttaagggcctgtga

SEQ ID NO: 925 - DNA, 1542 bp, Artificial Sequence
  source: /note="Description of Artificial Sequence: Synthetic polynucleotide"
atgctgagcaagaatctgtacagcaacaagaggctgctcaccagcaccaataccctcgtgcgcttcgctagcaccagatccacaggggtcgaaaactccggggcaggccccacaagctttaagaccatgaaggtcatcgaccctcagcacagcgacaagcccaacgtgctgatcctgggttctggctggggcgccatctcgtttctgaagcacatcgacaccaagaagtacaacgtttccatcatctctcccagaagctacttcatcttcacgcctctgttaccctctgccccagttggaaccgtagacgaaaagtccattattgagcccatcgtgaacttcgctctgaagaaaaaggggaacgtcacctactatgaggcagaggccacctctatcaatcccgaccggaataccgttaccatcaaaagcttatctgccgtgagccagctataccagcccgaaaaccacctggggctgcaccaggccgagcctgccgaaattaagtacgattatctgatcagcgccgtgggtgcggagcccaacacctttggaatccccggggtgaccgattacggtcatttcctgaaagagatccccaactctctggaaatcagacggacttttgccgccaacctggaaaaggccaacttattgccaaagggcgatcccgaaagaagaaggctgctgagcattgtcgtcgtgggcggaggccccacaggcgtggaggccgctggcgaactgcaggactacgtgcaccaggacctgagaaagttcctccctgccttggccgaagaaatccaaattcacctggtggaagccctgcccatcgtgttgaacatgttcgagaaaaagctgagcagctacgcccagtcacatctggaaaacacctccatcaaggtgcatctgagaaccgctgtggccaaagttgaagaaaagcagctgctggccaagaccaagcacgaagacggtaagataaccgaagaaactatcccatacggcaccctgatttgggccaccggcaacaaggccagacccgtgatcacagaccttttcaagaagatccccgagcaaaacagctccaagcggggactggcagtgaacgacttcctgcaagtgaaaggcagcaacaacattttcgccatcggtgacaacgcctttgctgggctgcctcctaccgcccaggtggcgcaccaggaagccgagtacttggccaagaacttcgataagatggctcaaatccccaatttccagaagaacctgtcttcacggaaggataagattgacctgctgttcgaggagaacaactttaagcccttcaaatacaacgacctgggcgccctggcctacctgggaagcgaaagggccattgccaccatacgtagcggcaagcggaccttctacaccggcggaggcttaatgaccttctacctgtggagaatcatctacatgagcatgattctgagcgcccgctcgagactgaaggtgttcttcgactggattaagttagccttcttcaaaagagacttttttaaaggactgtga

SEQ ID NO: 926 - DNA, 1542 bp, Artificial Sequence
  source: /note="Description of Artificial Sequence: Synthetic polynucleotide"
atgctgtcgaagaacctgtacagcaacaagcggttgctgacctcgaccaacacgctcgtgagattcgcctccaccagatccacaggcgtcgaaaactccggggctggtcccacaagcttcaagaccatgaaagtcatcgacccccagcacagcgacaagccaaacgtgctgatcctgggctcggggtggggcgccatttcgtttttaaagcacatcgacaccaagaagtacaacgtctccatcatcagccctagaagctatttcatctacacccccttgctgccttctgcccctgttggaacagtagacgaaaagtccatcatcgagcccatcgtgaactttgccctgaagaaaaagggcaacgttacctactacgaggcagaggccaccagcatcaaccccgaccggaataccgttaccatcaagagcctgagcgccgtgagccagctgtaccaacccgagaaccatctgggcctgcaccaggcagaacccgctgaaattaagtacgattacctgatcagtgctgtaggcgccgaacctaacacatttggtattcccggcgtcaccgattacggccatttcctgaaagaaatccccaacagcttggaaatccggcggaccttcgccgccaacctggaaaaggccaacctgttgcctaagggtgaccccgagcggagaaggctactgtccatcgtggtcgtgggcggtggccctactggtgtggaagctgctggtgaactgcaggattatgttcaccaggacctgcggaagttcctgcccgccttggccgaggaaatccaaattcacctggtggaagctctgcccatcgtgctgaatatgtttgagaagaagcttagcagctacgcccaaagccacctggaaaacacttccatcaaggtgcacctgagaacggctgtcgccaaggttgaagagaagcagttgctggcaaagacgaagcacgaggacggcaagattaccgaagaaaccattccatacggtactctgatttgggccaccggcaacaaggccagaccggtaatcacagacctgttcaagaaaatccctgagcagaacagcagcaagcggggattggccgtgaatgacttcctgcaggtgaaaggcagcaacaacatcttcgccatcggcgacaacgcctttgctggcttgcctccaacagcccaggtggcccaccaagaggccgaatatctggccaagaacttcgataagatggcccagatccccaatttccagaagaacctatcctcacggaaggataaaatcgacctgctgttcgaggaaaacaacttcaaacctttcaaatacaacgacctgggcgccctggcctacctgggatccgaaagagccattgccaccatccgttccggtaagagaacattctacaccggcggaggcttaatgaccttctacttatggagaattttgtacatgagcatgatcctatctgcacgctcgagactgaaggtgtttttcgactggatcaagttagcattcttcaagagagacttcttcaagggcctgtga

SEQ ID NO: 927 - DNA, 1542 bp, Artificial Sequence
  source: /note="Description of Artificial Sequence: Synthetic polynucleotide"
atgctaagcaagaatctgtatagcaacaagcggttgctgacctcgaccaataccctagtccgcttcgcctccaccagatccaccggggtggaaaactccggggctggccccaccagcttcaagaccatgaagatcatcgacccccagcacagcgacaaacccaacgtgctgatactgggttcggggtggggcgctatcagctttctgaagcacattgacaccaagaagtacaacgtctccatcgtgagccctagaagctacttcctgtttacccccttgctgcccagcgcccctgttgggaccgtggacgagaagtccatcattgagcccatcgtgaactttgccctgaagaaaaagggcaacgtcacctactacgaggccgaagccaccagcatcaaccccgaccggaacaccgtgaccataaagagcttatctgccgtgagccagctgtaccaacccgagaaccacctgggcctgcatcaagcagagcctgctgagattaagtacgactatttaatcagcgctgtaggcgcggagcccaacacatttggtattcccggcgtgaccgactacggccatttcctgaaggaaattcccaactctctggaaatcagacggactttcgccgccaacctggagaaggccaacttactgcctaagggtgatcccgagagaagaaggctactgtccattgtggtggttggcggaggccccactggcgtggaagccgctggcgagctgcaggattacgttcaccaggacctgcggaagttcctccctgccttggccgaagaaatccagattcacctggtcgaagccctgcccatcgtgttgaacatgttcgagaaaaagctgagcagctacgcccagagccatctggaaaacacctcgatcaaggtacatctgagaaccgccgtggccaaggtggaagaaaagcaactgctggcaaagacgaagcacgaggacggtaagataaccgaggaaactatcccatacggcaccctgatttgggccaccggtaacaaggccagaccggtgatcacagaccttttcaagaaaattcctgagcaaaacagcagcaagcggggcctggcagtgaacgacttcctgcaagtgaaaggcagcaacaacatcttcgccatcggcgacaacgcctttgccggcctgccacctaccgcccaggtggcccaccaggaggccgaatacctggccaagaattttgacaaaatggcccagatcccaaatttccagaagaacctatcttccagaaaggataaaatcgacctcctgttcgaggaaaacaacttcaaacccttcaagtacaacgatttaggcgccttagcctacctgggctccgaaagggccattgccaccataagaagcggcaagagaacattctacaccggcggaggcctgatgaccttctacctgtggcggatcttgtacatgagcatgattctgagcgccagaagcagactgaaggtcttcttcgactggatcaagctggccttcttcaaaagggacttttttaaaggactgtag

SEQ ID NO: 928 - DNA, 1542 bp, Artificial Sequence
  source: /note="Description of Artificial Sequence: Synthetic polynucleotide"
atgctaagcaagaacctgtatagcaacaagcggctgctcaccagcacgaataccctagtgcgcttcgcttccaccagatccaccggggtcgaaaacagcggagctggccctacctcttttaagaccatgaaggtcattgacccccagcacagcgacaagcccaacgtgctgatcctgggctcgggctggggcgccatcagctttctgaagcacatcgacaccaagaagtacaacgttagcatcgtgagccccagaagctacttcatctacacgcccttgttacccagcgcacctgttgggacagtggacgaaaagtccatcatcgagcccatcgtgaacttcgctctcaagaaaaagggcaacgttacctactatgaggccgaggccaccagcatcaaccccgaccggaacaccgttaccataaagtcactgtctgccgttagccagctataccagcccgaaaaccacctgggcctgcatcaggcagaacctgccgaaattaagtacgactatctgatcagcgctgtgggtgccgagcccaacacctttggtatccctggggtcactgactacggccacttcctgaaggaaatccccaacagcctggaaatccggcggactttcgccgccaacctagagaaggccaacttactgcctaagggtgaccccgagcggagaaggctactgagcattgtcgtggtgggtggaggccccacaggcgtggaagctgctggtgagctgcaggattatgtgcaccaggacctgagaaagttcctccctgcattggccgaggaagtgcaaattcacctggtggaagccctgcccatcgttctgaacatgttcgagaaaaagctgagctcatacgcccaaagccacttagaaaacacttcgatcaaagtacacctgagaaccgccgtcgccaaggtggaagaaaagcagttgctggccaagaccaaacacgaggacggtaagataaccgaagaaaccattccatacggcaccctgatttgggccacgggtaacaaggcaagacccgtaatcaccgacctgttcaagaagattcccgagcagaacagctccaagcggggcctggccgtgaatgacttcctgcaggtcaaaggcagcaacaacattttcgccatcggcgacaacgcatttgccgggctgccaccaaccgcccaggtggcccaccaagaggccgagtacttggccaagaacttcgataagatggctcaaatccccaatttccagaagaatctgtcctcccggaaggataagatcgacctcttgttcgaggagaacaacttcaagcccttcaaatacaacgacttaggcgccctggcatacctgggctccgaaagagccattgcaaccatcagatccggcaagcggacattttacaccggcggaggcctgatgaccttctacctgtggagaattatctacctgagcatgatcctgagcgcccgcagcagactgaaggtctttttcgactggattaagctggcattcttcaagagagacttctttaagggattatga

SEQ ID NO: 929 - DNA, 1542 bp, Artificial Sequence
  source: /note="Description of Artificial Sequence: Synthetic polynucleotide"
atgctaagcaagaatctgtatagtaacaagaggctgctgaccagcaccaacaccctagtgagattcgccagcaccagatccaccggcgtcgaaaacagcggagctggccctacctcttttaagaccatgaaagtcattgaccctcagcacagcgacaaacccaacgtgctgatcctgggttctggctggggcgctatctcgtttctgaagcacatcgacaccaagaagtacaacgtctccatcatcagccccagaagctatttcatctacacccccctgttacctagcgccccagttggaaccgtggacgaaaagtcaatcatcgagcccatcgttaacttcgctctcaagaaaaagggcaacgtcacctactacgaggccgaagccacctctatcaaccccgacaggaacaccgtgaccatcaaaagcctgtctgccgtttcccagctgtaccagcccgaaaaccacctgggcctgcaccaggcagagcctgccgagattaagtacgactatttaatcagcgctgtaggcgccgagcctaacacatttggaatccccggggtcaccgactacggccacttcctgaaggaaattcccaacagcttggaaataagacggacctttgccgccaacctagaaaaggctaacctgctgcctaagggcgaccccgaaagaagaagactactgagcattgtggtcgtgggtggaggccccacaggcgtagaggctgctggcgagctacaggattatgtgcaccaggacctgcggaagttcctgcccgccttggccgaggaaatccagattcacttggtcgaagccctgcccatcgtgttgaacatgttcgagaagaagctttcatcatacgcccaaagccatctggaaaacacctcgatcaaggtgcatctgagaacggctgtggccaaagtggaagagaagcagctgctggccaagaccaaacacgaagacggcaagattaccgaggaaaccatcccctacggtaccttgatttgggccaccggtaacaaggccagacccgtgatcaccgacctgttcaagaagatccctgagcagaacagcagcaagagaggcctggccgtgaatgacttcctgcaagtgaaaggcagcaacaacattttcgccatcggtgacaacgcatttgccggcctgcctcctacagcccaggtggcccaccaagaggccgaatacctggccaagaactttgacaagatggctcagatacccaatttccagaagaacctatcctcacggaaggataagattgatctcctgttcgaggagaacaactttaagcccttcaagtacaacgacttaggcgccttagcctacctgggaagcgaaagagccattgccaccatcagatccggtaagcggacattttacaccggtggaggcctgatgaccttctacttatggcggattttgtacatgtccatgatcctgtctgccagatcgagactgaaggtgttcttcgactggattaagctggcattcttcaagagagactttttcaaaggattatag

SEQ ID NO: 930 - DNA, 1542 bp, Artificial Sequence
  source: /note="Description of Artificial Sequence: Synthetic polynucleotide"
atgctaagcaagaatctgtatagcaacaagcggttgctcaccagcaccaacaccctcgtgagattcgctagcaccagatccacaggggtggaaaactccggggcaggccctaccagcttcaagaccatgaaaatcatcgaccctcagcacagcgacaagccaaacgtgctgatcctgggctctgggtggggagctatttcgtttttaaagcacatcgacaccaagaagtacaacgttagcatcatcagccccagaagctatttcatcttcacccctttgctgcctagcgcccctgtggggaccgtagacgagaagtccattatcgagcccatcgttaacttcgctctcaagaaaaagggcaacgtcacctactacgaggcagaggccacctctatcaatcccgaccggaataccgttaccatcaagagcctgagcgccgtgtcccagctgtaccaacccgagaaccacctgggcctgcaccaggccgaacctgctgagattaagtacgactatctgatcagcgctgtgggtgccgagcctaacacctttggaattcccggggtgaccgactacggccatttcctgaaggagatccccaactctttggaaatcagaagaaccttcgccgccaatctggagaaggctaacctgctgcctaagggtgaccccgagagaagaaggctgctgtccatcgtggtggttggtggtggccccacaggcgtggaagccgctggtgaactacaggactacgtgcaccaggacctgagaaagtttctccccgccttggccgaggaagtccagattcacttggtggaagctctgcccatcgttctgaacatgttcgagaaaaagctgagcagctacgcgcagagccatctggaaaacacctccatcaaagtgcatctgagaacggccgtcgccaaagtggaagaaaagcagttgctggcaaagaccaagcacgaggacggtaagataaccgaggaaaccattccctacggcaccctgatttgggccaccggcaacaaggcaagacccgtgatcaccgacctgttcaagaagattcctgagcagaactcgagcaagcggggcctggccgtgaacgactttctgcaggtcaaaggcagcaacaacatcttcgccattggcgacaacgcctttgccgggttgccacctaccgcccaggtggcccaccaggaggccgagtatttggccaagaattttgataagatggctcagatccccaatttccagaagaatctgtcctcacggaaggataagatcgacctgttgttcgaggaaaacaacttcaagcccttcaagtacaacgatctgggtgccttagcctacctgggcagcgaaagggccattgccaccatccgttccggtaagcggaccttttacaccggcggaggcttaatgaccttctacctgtggcggattatctacatgagcatgatcctgtctgcacgcagcagattaaaggtgtttttcgactggatcaagctggcattcttcaaaagggacttctttaaaggcttatga

SEQ ID NO: 931 - DNA, 1542 bp, Artificial Sequence
  source: /note="Description of Artificial Sequence: Synthetic polynucleotide"
atgctaagcaagaacctgtacagtaacaagcggttgctgaccagcacgaacaccctagtcagattcgcctccaccagatccaccggggtcgaaaacagcggggcaggccctacaagcttcaagaccatgaaagtcatcgacccccagcacagcgacaagcccaacgtgctgatcctgggctcgggctggggcgccatcagctttctgaagcacatcgacaccaagaagtacaacgttagcatcatctctcctagaagctatttcatctacacgcctctgctgcccagcgcacctgttggaacagtggacgagaagtcaattattgagcccatcgtgaacttcgctctcaagaaaaagggcaacgtcacctactacgaggcagaggccaccagcatcaatcccgaccggaataccgtgaccataaagagcttatctgccgttagccagctgtaccaacccgaaaaccacctggggctgcatcaggccgagcccgctgaaattaagtacgactatttaatcagtgccgtgggcgccgaacccaacacatttggtattcccggggtcactgattacggtcatttcctgaaagagatccccaactctctggaaatccggagaactttcgccgccaatctagagaaggccaacttactgcctaagggtgaccccgaacggagaagactgctgagcatcgtggtcgttggtggtggccccactggcgtggaagctgctggcgagctgcaggattacgttcaccaggacctgcggaagttcctgcccgcattggccgaagaaatccagattcacttggtggaagccctgcccatcgttctgaacatgttcgagaagaagcttagcagctacgcccaaagccacttagaaaacacctccatcaaagtgcatctgagaaccgccgtcgccaaagttgaagaaaagcaactgttggcaaagaccaaacacgaggacggcaagattaccgaggaaaccatcccctacggcactctgatttgggccaccggcaacaaggcaagacccgtaatcacagacctgttcaagaaaattcccgagcagaacagcagcaagagaggactggcagtgaacgacttcctgcaggtcaaaggcagcaacaacatcttcgccatcggcgacaatgcctttgccggcttgcctccaacagcccaagtggcccaccaggaagccgagtatctggccaagaatttcgataaaatggctcaaatacccaatttccaaaagaacctgtcttcccggaaggataaaatcgatctcctgttcgaggaaaacaacttcaagcctttcaagtacaacgacctgggcgccctggcatacctgggctccgaaagggccattgcaaccatcagaagcggcaagcggaccttttacaccggtggaggcctgatgaccttctacctgtggcggattctgtacatgtccatgatcctgagcgcaagatcgagactgaaggtctttttcgactggatcaaactggccttcttcaagagggacttcttcaagggcctgtga

SEQ ID NO: 932 - DNA, 1542 bp, Artificial Sequence
  source: /note="Description of Artificial Sequence: Synthetic polynucleotide"
atgctaagcaagaacctgtacagtaacaagaggttgctgaccagcaccaataccctagtgcgcttcgcctccaccagatccaccggggtggaaaacagcggagctggccccacctcttttaagaccatgaaaatcatcgacccccagcacagcgacaaacccaacgtgctgatcctgggctctgggtggggcgctatcagctttttaaagcacatcgacaccaagaagtacaacgtcagcatcgtgagccctagaagctacttcctgttcacccctctgctgccttctgcccctgttgggacagtggacgagaagtccatcatcgagcccatcgtgaacttcgccctgaagaaaaagggcaacgtcacctactatgaggccgaggccaccagcatcaaccccgacaggaataccgtgaccatcaagtcattatctgccgtgtcccagctgtaccaacccgagaaccatctaggcctgcaccaagcagagcccgccgagattaagtacgactacttaatcagcgctgtaggcgcggagcccaacacctttggaatccctggcgtgaccgactacggccatttcctgaaggaaatccccaactctctggaaatacggcggacttttgccgccaacctggaaaaggctaacctgttgccaaagggtgaccccgagagaagaaggctactgtccatcgtcgtggttggcggaggccccactggcgtggaggctgctggtgaactgcaggattatgtgcaccaggacctgcggaagttcctgcccgccctggccgaagaagtgcagattcacctggtcgaagctctgcccatcgtgttgaatatgttcgagaaaaagctgtcatcatacgcgcaatcacatctggaaaacacctcgatcaaggtacatctgagaacggctgtggccaaagtggaagaaaagcaactgctggccaagacgaagcacgaggacggtaaaataaccgaggaaactatcccctacggcaccctgatttgggccacgggcaacaaggccagaccggtgatcaccgaccttttcaagaagattcctgagcagaacagcagcaagcggggattggccgtgaacgactttctgcaggtcaaaggcagcaacaacattttcgccattggtgacaacgcatttgctggcttgcctccaacagcccaggtggcgcaccaggaggccgagtatctggccaagaacttcgacaaaatggcccaaatccccaatttccaaaagaacctatcttcaagaaaggataagattgacctgctgttcgaggaaaacaacttcaagcctttcaagtacaacgatctgggcgccttagcatacctgggctccgaaagagccattgcaaccatcagatccggtaagcggaccttctacaccggcggtggcttaatgaccttctacctgtggcggatcatctacatgagcatgatcctgtctgcccgcagcagactgaaggtgtttttcgactggatcaagctggcattcttcaaaagggacttctttaagggcctgtga

SEQ ID NO: 933 - DNA, 1542 bp, Artificial Sequence
  source: /note="Description of Artificial Sequence: Synthetic polynucleotide"
atgctgagcaagaatttgtatagtaacaagaggctgctcacctcgaccaatacgctcgtgcgcttcgctagcaccagatccacaggcgtggaaaacagcggagcaggtcccaccagcttcaagaccatgaaaatcattgaccctcagcacagcgacaaaccaaacgtgctgatactgggctctggctggggcgccatttcgtttttaaagcacatcgacaccaagaagtacaacgttagcatcgtgagccccagaagctatttcctgtacacccctttgctgcccagcgcaccagtggggacagtggacgagaagtccattatcgagcccatcgtgaacttcgccctgaagaaaaaggggaacgtcacctactatgaggccgaggccacctctatcaatcccgaccggaacaccgtgaccatcaaaagcctgtctgccgtttcccagctataccagcccgagaaccacctgggcctgcatcaggcagagcctgccgaaattaagtacgattacctgatcagcgccgtaggcgccgagcccaacacctttggaatccctggcgtgaccgattacggtcatttcctgaaagagatccccaacagcctggaaataagacggaccttcgccgccaatctggaaaaggctaacttattgccaaagggcgatcccgaaagaagaaggctgctgtccatcgtggtggtgggcggaggccccactggtgtggaagctgctggtgaactacaggactacgtgcaccaggacctgcggaagttcctgcctgcactggccgaagaagtgcagattcacctggtcgaagccctgcccatcgtgctgaatatgttcgagaaaaagctgtcaagctacgcgcagtcacacttagaaaacacctccatcaaagtacacctgagaaccgccgtcgccaaggtggaagagaagcaactgttggccaagaccaagcacgaggacggcaagataaccgaagaaaccatcccctacggtaccttgatttgggccacgggcaacaaggccagacccgtgatcacagacctgttcaagaaaattcctgagcagaacagctccaagagaggcttggccgtgaacgactttttgcaggtcaaaggcagcaacaacattttcgccatcggcgacaacgcctttgccggcttgcctcctacagcccaggtggcccaccaagaagccgagtatctggccaagaattttgacaagatggcccaaatccccaatttccaaaagaatctgtcttcacggaaggataagatcgacctgctgttcgaggaaaacaacttcaagcctttcaagtacaacgacttaggtgccctggcctacctgggaagcgaaagggccattgccaccatccgttccggtaagcggaccttttacaccggtggtggcctgatgaccttctacctgtggcggatcttgtacatgtccatgatcctgtctgcacgctcgagactgaaggtcttcttcgactggattaagctggccttcttcaaaagggactttttcaaaggactgtga

SEQ ID NO: 934 - DNA, 1542 bp, Artificial Sequence
  source: /note="Description of Artificial Sequence: Synthetic polynucleotide"
atgctaagcaagaatttgtatagcaacaagaggttgctgacctcgaccaataccctcgtgcgcttcgcctccaccagatccaccggggtcgaaaactccggggctggtcccacctctttcaagaccatgaagatcattgaccctcagcacagcgacaaacccaacgtgctgatactgggttcgggctggggagctatcagctttctgaagcacatcgacaccaagaagtacaacgtcagcatcatctctcccagaagctacttcctgtacacccctctgctgccttctgcaccagttgggaccgtagacgaaaagtccatcatcgagcccatcgtgaatttcgctctgaagaaaaagggcaacgttacctactacgaggccgaagccaccagcatcaaccccgaccggaacaccgttaccataaagagcttaagcgccgtttcccagctataccaacctgaaaaccatctgggcctgcaccaagccgagcctgccgaaattaagtacgattacctgatcagcgccgtgggtgccgaacccaacacatttggaattcccggggtgactgactacggccacttcctgaaagagattcccaacagcttggaaatccggcggacctttgccgccaacctggaaaaggccaacttactgccaaagggtgaccccgaacggagaaggctactgtccatcgtcgtcgttggcggtggccctacaggcgtggaagctgctggtgaactgcaggactatgttcaccaggacctgagaaagttcctccccgcattggccgaggaaatccagattcacctggtggaagccctgcccatcgtgctgaacatgtttgagaagaagcttagctcatacgcccaaagccatttagaaaacacctccatcaaggtgcatctgagaaccgccgtcgccaaggttgaagagaagcaactgttggcaaagacgaagcacgaagacggcaaaattaccgaagaaaccattccctacggtaccctgatttgggccacgggtaacaaggccagaccggtaatcacagacctgttcaagaagatccccgagcaaaactcgagcaagcggggcttggcagtgaatgacttcctgcaggtgaaaggcagcaacaacatcttcgccattggcgacaatgcctttgccgggctgcctcctacagcccaagtggcgcaccaagaagccgagtacctggccaagaacttcgataagatggcccagatccccaatttccaaaagaacctgtcctccagaaaggataaaattgacctgctgttcgaggaaaacaacttcaaacccttcaagtacaacgacctgggcgccctggcctacctgggaagcgaaagggccattgccaccatccgtagcggtaagcggaccttctacaccggcggtggcctgatgaccttctacttatggcggatcttgtacatgagcatgatcctgtctgccagaagcagactgaaggtgttcttcgactggatcaagctggccttcttcaaaagggactttttcaagggactgtag

SEQ ID NO: 935 - DNA, 1542 bp, Artificial Sequence
  source: /note="Description of Artificial Sequence: Synthetic polynucleotide"
atgctaagcaagaatttgtatagcaacaagcggttgctcaccagcaccaacaccctagtccgcttcgccagcaccagatccaccggggtcgaaaactccggggctggccccacaagctttaagaccatgaagatcatcgaccctcagcacagcgacaagcccaacgtgctgatactgggctctgggtggggcgctatctcgtttctgaagcacatcgacaccaagaagtacaacgtttccatcgtgtctcccagaagctatttcatctacacgcccttgttacccagcgcacctgtgggaacagtggacgagaagtcaatcatcgagcccatcgtgaatttcgccctgaagaaaaagggcaacgtcacctactacgaggccgaggccaccagcatcaatcccgaccggaacaccgtgaccataaaatcactgtctgccgtgagccagctgtaccaacccgaaaaccacctaggcctgcaccaagccgagcctgccgagattaagtacgactacctgatcagcgccgtaggcgcggagcccaacacctttggaatccccggcgtgaccgactacggtcatttcctgaaggagatccccaacagcctggaaataagaagaaccttcgccgccaacctagagaaggctaacctgttgccaaagggtgatcccgaaagaagaagactgctgagcatcgtcgtcgttggtggtgggcccacaggcgtggaagctgctggtgagctacaggactacgttcaccaggacctgcggaagttcctgcccgccctggccgaagaagtccagattcacctggtggaagccctgcccatcgtgctgaacatgttcgagaagaagctttcatcatacgcccaatcacacctggaaaacacttccatcaaagtgcacctgagaaccgccgtggccaaggtggaagaaaagcaactgttggcaaagaccaaacacgaagacggtaagattaccgaggaaactattccatacggcactttgatttgggccaccggcaacaaggcaagaccggtaatcaccgacctgttcaagaagatccccgagcagaactcgagcaagagaggactggccgtgaacgacttcttgcaggtcaaaggcagcaacaacatcttcgccattggtgacaatgcctttgccggcctgccacctaccgcccaggtggcccaccaagaggccgagtatttggccaagaacttcgacaagatggcccagatacccaatttccaaaagaacctgtcctcacggaaggataagatcgacctgctgttcgaggaaaacaacttcaagcctttcaagtacaacgatctgggcgccctggcctacctgggctccgaaagagccattgcaaccatccgtagcggtaagcggacattctacaccggtggtggcttaatgaccttctacctgtggagaatcctgtacatgagcatgatcctatctgcccgcagcagactgaaggtcttcttcgactggattaaattagcctttttcaaaagagacttcttcaaaggattatag

SEQ ID NO: 936 - DNA, 1542 bp, Artificial Sequence
  source: /note="Description of Artificial Sequence: Synthetic polynucleotide"
atgctgagcaagaacctgtatagcaacaagaggttgctcacctcgaccaacaccctagtgcgcttcgctagcaccagatccacaggcgtcgaaaacagcggagctggccctacctctttcaagaccatgaagatcattgaccctcagcacagcgacaaaccaaacgtgctgatcctgggttcgggctggggcgccatctcgtttttaaagcacatcgacaccaagaagtacaacgttagcatcgtgagccccagaagctacttcatctacacccctctgttaccttctgccccagtgggaaccgtggacgaaaagtcaatcattgagcccatcgtgaacttcgccctgaagaaaaagggcaacgtcacctactacgaggcagaagccaccagcatcaaccccgaccggaacaccgtgaccatcaagagcttaagcgccgtgtcccagctgtaccaacctgagaaccatctaggcctgcatcaagccgaacccgccgaaattaagtacgactatctgatcagtgccgtaggtgccgaacctaacacatttggtattcccggcgtgaccgattacggccacttcctgaaagagattcccaactctctggaaataagacggaccttcgccgccaatctagaaaaggccaacctgttgcctaagggtgaccccgaacggagaaggctgctgagcattgtcgtcgtgggcggaggccccacaggtgtagaggctgctggcgaactgcaggactatgtgcaccaggacctgcggaagttcctgcccgccctggccgaggaagtgcaaattcacctggtcgaagccctgcccatcgtgctgaatatgtttgagaaaaagctgtcatcatacgcccagagccacctggaaaacacctccatcaaggtacacctgagaacggccgtggccaaagtggaagagaagcagttgctggcaaagaccaaacacgaagacggcaaaattaccgaggaaactattccctacggcaccttgatttgggccacgggtaacaaggcaagaccggtaatcaccgacctgttcaagaagatccctgagcagaactcgagcaagcggggcctggcagtgaacgacttcctgcaggtcaaaggcagcaacaacatcttcgccattggcgacaacgcatttgctgggttgcctcctaccgcccaggtggcgcaccaagaggccgagtacttggccaagaacttcgacaagatggcccaaatccccaatttccaaaagaacctgtcttcccggaaggataaaatcgatctcttgttcgaggaaaacaacttcaaacccttcaaatacaacgatctgggcgccctggcatacctgggcagcgaaagagccattgccaccatacgtagcggcaagagaacattctacaccggcggtggcctgatgaccttctacctgtggcggatcatctacctgagcatgatcctgtctgcaagaagcagattaaaggtctttttcgactggatcaagctggcatttttcaaaagggacttcttcaagggattatga

SEQ ID NO: 937 - DNA, 1542 bp, Artificial Sequence
  source: /note="Description of Artificial Sequence: Synthetic polynucleotide"
atgctgagcaagaacctgtatagcaacaagcggttgctgacctcgaccaacaccctagtgcgcttcgcctccaccagatccacaggggtggaaaacagcggggcaggccctaccagcttcaagaccatgaaggtcatcgaccctcagcacagcgacaagccaaacgtgctgatcctgggttcggggtggggcgctatctcgtttctgaagcacatcgacaccaagaagtacaacgttagcatcgtgagccccagaagctacttcttatacacgcccctgttacccagcgccccagttggaacagtggacgaaaagtcaatcattgagcccatcgttaacttcgccctgaagaaaaagggcaacgtcacctactacgaggccgaggccaccagcatcaaccccgacaggaacaccgttaccatcaaatcactgagcgccgttagccagctataccagcccgagaaccacctagggctgcatcaggccgagcccgccgagattaagtacgattacttaatcagcgctgtgggcgcggagcctaacacatttggaatccctggcgtgaccgattacggtcacttcctgaaggaaatccccaactctctggaaatccggagaacttttgccgccaatctagagaaggccaacctgctgccaaagggtgaccccgaaagaagaagactgctgagcattgtggtcgttggcggtggccccacaggtgtagaggctgctggcgagctacaggattatgtgcaccaggacctgcggaagtttctccccgccttggccgaagaaatccagattcacctggtggaagccctgcccatcgtgttgaacatgttcgagaagaagctgtcaagctacgcgcagagccacttagaaaacacctccatcaaggtgcacctgagaaccgccgtcgccaaagttgaagaaaagcaactgctggccaagacgaagcacgaagacggcaagataaccgaagaaactatcccctacggcaccctgatttgggccaccggtaacaaggcaagaccggtgatcaccgacctgttcaagaaaatccctgagcaaaacagcagcaagcggggcttggccgtgaatgacttcttgcaggtcaaaggcagcaacaacatcttcgccatcggcgacaacgcatttgccgggttgccacctacagcccaagtggcgcaccaggaagccgagtacctggccaagaattttgacaagatggcccaaatccccaatttccaaaagaacctgtcctcccggaaggataaaatcgacctgctgttcgaggaaaacaactttaagcctttcaagtacaacgatctgggcgccttagcctacctgggcagcgaaagagccattgccaccatcagatccggcaagcggacattctacaccggtggaggcctgatgaccttctacttatggagaatcatctacatgtccatgatcctgagcgcaagaagcagattaaaggtgttcttcgactggattaaattagcattcttcaagagagacttcttcaagggactgtag

SEQ ID NO: 938 - DNA, 1542 bp, Artificial Sequence
  source: /note="Description of Artificial Sequence: Synthetic polynucleotide"
atgctgagcaagaatctgtatagtaacaagcggctgctgaccagcacgaatacgctcgtcagattcgctagcaccagatccacaggcgtcgaaaactccggagctggtcccacatctttcaagaccatgaaaatcatcgacccccagcacagcgacaagcccaacgtgctgatcctgggctctggctggggcgctattagctttctgaagcacatcgacaccaagaagtacaacgtctccatcgtgagccccagaagctatttcttatacacccccctgctgcccagcgccccagtgggaaccgtggacgagaagtcaatcattgagcccatcgtgaactttgccctcaagaaaaagggcaacgtcacctactacgaggcagaagccaccagcatcaaccccgacaggaacaccgttaccatcaaatcattaagcgccgtttcccagctgtaccaacccgagaaccatctaggcctgcaccaagcagaacctgctgaaattaagtacgattacctgatcagcgctgtgggcgccgagcccaacacctttggaattcccggggtgaccgattacggccatttcctgaaggagatccccaacagcctggaaatacggcggacttttgccgccaacctagaaaaggctaacttactgcctaagggcgatcccgagagaagaagactgctgagcatcgtggtcgttggcggagggcctactggcgtagaagccgctggtgaactgcaggactacgtgcaccaggacctgagaaagtttctgcccgcactggccgaggaaatccagattcacctggtcgaagctctgcccatcgttctgaacatgttcgagaagaagcttagcagctacgcccagagccacctggaaaacacttccatcaaggtgcacctgagaacggccgtcgccaaagtggaagagaagcagttgctggcaaagaccaagcacgaagacggcaagataaccgaagaaaccatcccatacggcaccctgatttgggccaccggtaacaaggccagacccgtgatcaccgaccttttcaagaagattcctgagcaaaacagcagcaagagaggactggcagtgaacgacttcctgcaagtgaaaggcagcaacaacatcttcgccatcggcgacaacgcctttgccgggttgccacctacagcccaggtggcgcaccaggaggccgaatatctggccaagaatttcgacaagatggcccagatccccaatttccagaagaatctgtcttcccggaaggataagatcgatctgctgttcgaggagaacaacttcaagcctttcaaatacaacgatttaggtgccttagcatacctgggatccgaaagagccattgccaccatccgttccggcaagcggacattctacaccggcggtggcctgatgaccttctacttatggagaattctgtacatgagcatgattctaagcgcccgctcgagactgaaggtgttcttcgactggatcaagctggcctttttcaagagggacttttttaagggactgtga

SEQ ID NO: 939 - DNA, 1542 bp, Artificial Sequence
  source: /note="Description of Artificial Sequence: Synthetic polynucleotide"
atgctgagcaagaacctgtatagcaacaagaggctgctgaccagcaccaacacgctagtgcgcttcgccagcaccagatccacaggcgtggaaaactccggggctggccctacaagcttcaagaccatgaaggtcattgacccccagcacagcgacaaacccaacgtgctgatactgggttctgggtggggcgccattagctttctgaagcacatcgacaccaagaagtacaacgtctccatcgtgagccccagaagctacttcatctacacccccttgttaccttctgccccagtgggaaccgtagacgagaagtcaattattgagcccatcgtgaactttgctctcaagaaaaagggcaacgtcacctactatgaggcagaggccacctctatcaaccccgacaggaacaccgtgaccatcaagtcactgagcgccgtttcccagctgtaccaacctgaaaaccacctgggcctgcaccaagccgaacctgccgagattaagtacgactacctgatcagtgctgtaggcgccgaacccaacacctttggaattcccggcgtgaccgactacggccacttcctgaaagagatccccaacagcctggaaatacggcggaccttcgccgccaatctggaaaaggctaacttactgcctaagggcgatcccgaaagaagaaggctgctgagcatcgtggtcgttggcggtgggcccacaggtgtggaggccgctggtgagctgcaggactacgttcaccaggacctgagaaagtttctgcccgccctggccgaggaagtgcaaattcacctggtcgaagccctgcccatcgtgttgaacatgttcgagaagaagctgtcaagctacgcgcaaagccacttagaaaacacctccatcaaggtgcatctgagaaccgctgtggccaaggttgaagaaaagcagctgctggccaagaccaagcacgaggacggtaaaattaccgaggaaactattccatacggtaccctgatttgggccaccggcaacaaggcaagaccggtaatcacagaccttttcaagaagattcccgagcaaaactcgtccaagagaggattggcagtgaatgactttttgcaagtcaaaggcagcaacaacatcttcgccattggtgacaatgcctttgctgggctgccacctaccgcccaagtggcccaccaagaagccgagtacttggccaagaatttcgacaagatggcccagatcccaaatttccagaagaacctgtcctccagaaaggataaaattgacctcctgttcgaggaaaacaacttcaaacctttcaaatacaacgatttaggtgccttagcctacctgggaagcgaaagagccattgcaaccatcagatccggcaagcggaccttctacaccggcggaggcttaatgaccttctacctgtggcggatcatctacatgagcatgatcctaagcgcacgcagcagactgaaggtgttcttcgactggatcaagctggccttcttcaagagggacttcttcaagggattatag

SEQ ID NO: 940 - DNA, 1542 bp, Artificial Sequence
  source: /note="Description of Artificial Sequence: Synthetic polynucleotide"
atgctaagcaagaatttgtatagtaacaagcggctgctcaccagcacgaacacgctcgtccgcttcgccagcaccagatccaccggggtcgaaaacagcggagcaggccccacaagctttaagaccatgaagatcatcgaccctcagcacagcgacaaacccaacgtgctgatcctgggctctggctggggagctatctcgtttctgaagcacattgacaccaagaagtacaacgtctccatcgtgtctcccagaagctatttcatctttacgcccctgctgcccagcgcccctgttggaaccgtagacgagaagtcaattatcgagcccatcgtgaatttcgccctgaagaaaaagggcaacgtcacctactacgaggccgaggccaccagcatcaaccccgaccggaataccgttaccatcaaaagcctgagcgccgtgagccagctgtaccagcctgagaaccatctaggcctgcatcaggccgaacctgccgaaattaagtacgactacctgatcagcgctgtaggtgccgagcctaacacctttggaatccctggcgtgaccgattacggtcatttcctgaaggagattcccaactctttggaaatacggagaaccttcgccgccaacctggaaaaggctaacttactgccaaagggtgatcccgagcggagaaggctgctgagcatcgtggtcgtgggtggtggccccacaggcgtagaagccgctggcgagctgcaggactacgtgcaccaggacctgcggaagtttctccccgcactggccgaggaagtgcaaattcacttggtggaagctctgcccatcgtgctgaacatgttcgagaaaaagctgagctcatacgcgcagtcacacctggaaaacacctcgatcaaggtgcacctgagaaccgccgtcgccaaagtggaagaaaagcaattgctggccaagacgaagcacgaagacggcaaaataaccgaagaaactattccatacggcaccctgatttgggccacgggtaacaaggccagacccgtgatcaccgaccttttcaagaaaatccccgagcaaaactcgagcaagcggggcttggcagtgaacgacttcctgcaggtcaaaggcagcaacaacattttcgccatcggcgacaatgcctttgccggcttgccacctacagcccaggtggcgcaccaggaagccgaatacctggccaagaacttcgataagatggctcaaataccaaatttccaaaagaacctatcttcccggaaggataagattgacctcttgttcgaggaaaacaacttcaagcctttcaaatacaacgacctgggtgccctggcctacctgggaagcgaaagggccattgccaccatcagaagcggtaagcggacattctacaccggcggaggcttaatgaccttctacctgtggagaatcatctacatgtccatgatcctgagcgcccgcagcagattaaaggtgttcttcgactggatcaaactggcattcttcaagagggacttttttaagggcttatga

SEQ ID NO: 941 - DNA, 1542 bp, Artificial Sequence
  source: /note="Description of Artificial Sequence: Synthetic polynucleotide"
atgctgtcgaagaacctgtacagtaacaagcggctgctcaccagcaccaacacgctagtgagattcgcctccaccagatccaccggggtcgaaaactccggggctggtcctacaagcttcaagaccatgaaaatcatcgacccccagcacagcgacaagcccaacgtgctgatactgggctctgggtggggcgccatcagctttctgaagcacattgacaccaagaagtacaacgtcagcatcgtgagccctagaagctacttcatcttcacccccctgctgcccagcgcccctgtgggaaccgtggacgagaagtccattattgagcccatcgtgaacttcgctctgaagaaaaaggggaacgttacctactatgaggccgaggccacctctatcaatcccgaccggaataccgtgaccataaaatcattatctgccgtttcccagctgtaccagcccgagaaccatctggggctgcatcaagccgaacccgccgagattaagtacgactacctgatcagtgctgtgggcgcggagcccaacacatttggtattcctggggtcactgactacggccacttcctgaaggagatccccaacagcttggaaatacggcggacctttgccgccaacctggaaaaggctaacttactgcctaagggcgaccccgaacggagaaggctgctgtccattgtggtcgtgggtggaggccctacaggcgtagaagccgctggtgagctgcaggactacgttcaccaggacctgcggaagttcctgcctgccttggccgaggaaatccaaattcacctggtggaagccctgcccatcgttttgaatatgtttgagaagaagcttagcagctacgcccaaagccacctggaaaacacctccatcaaggtgcatctgagaaccgctgtggccaaggtggaagagaagcagctgctggccaagaccaagcacgaagacggcaaaattaccgaggaaaccatcccatacggcaccttgatttgggccacgggtaacaaggcaagaccggtaatcacagaccttttcaagaagattcctgagcaaaactcgtccaagcggggcctggcagtgaacgactttctgcaagtcaaaggcagcaacaacattttcgccattggtgacaatgcatttgctggcctgccaccaacagcccaagtggcgcaccaggaagccgagtacctggccaagaatttcgacaagatggcccaaatccccaatttccaaaagaatctatcctcacggaaggataaaatcgatctgctgttcgaggaaaacaacttcaaacctttcaagtacaacgatttaggtgccctggcctacctgggaagcgaaagggccattgccaccataagatccggcaagcggaccttctacaccggcggtggcctgatgaccttctacctgtggcggatcatctacttgtccatgatcctgtctgcaagatcgagactgaaggtgttcttcgactggatcaagctggcatttttcaaaagagacttcttcaagggcctgtga

SEQ ID NO: 942 - DNA, 1542 bp, Artificial Sequence
  source: /note="Description of Artificial Sequence: Synthetic polynucleotide"
atgctatcgaagaacttgtacagcaacaagcggctgctcaccagcaccaataccctcgtgagattcgccagcaccagatccacaggcgtcgaaaacagcggggcaggccctacaagcttcaagaccatgaaaatcatcgacccccagcacagcgacaagcccaacgtgctgatactgggctctggctggggagctatctcgtttttaaagcacatcgacaccaagaagtacaacgtcagcatcgtgtctcctagaagctatttcctgtacacccccctgttacccagcgcacctgtgggaaccgtggacgagaagtccatcattgagcccatcgtgaatttcgccctcaagaaaaagggcaacgtcacctactacgaggcagaagccaccagcatcaaccccgacaggaacaccgtgaccatcaaatcattaagcgccgtgtcccagctgtaccagcccgaaaaccacctaggcctgcatcaggcagagcctgccgagattaagtacgactacttaatcagcgccgtaggtgccgaacccaacacctttggtatccctggggtgaccgactacggtcacttcctgaaggaaattcccaacagcttggaaatacggcggactttcgccgccaacctggaaaaggctaacttactgcctaagggtgaccccgaaagaagaaggctactgtccatcgtggtcgttggcggaggccctacaggcgtggaagctgctggcgagctacaggattacgttcaccaggacctgcggaagttcctgcccgcactggccgaggaaatccagattcacttggtcgaagccctgcccatcgtgttgaacatgtttgagaagaagcttagctcatacgcgcagtcacatttagaaaacacctccatcaaggtgcatctgagaaccgccgtggccaaagtggaagaaaagcagctgctggcaaagaccaagcacgaggacggtaagattaccgaagaaaccattccatacggcaccctgatttgggccaccggcaacaaggcaagaccggtaatcacagaccttttcaagaagatccctgagcagaacagcagcaagagaggattggccgtgaacgactttctgcaagtcaaaggcagcaacaacattttcgccattggtgacaacgcctttgccggcctgccacctacagcccaggtggcccaccaggaagccgaatacttggccaagaacttcgacaaaatggctcagatccccaatttccaaaagaacctgtcttcacggaaggataaaattgacctcttgttcgaggagaacaactttaagcccttcaagtacaacgatctgggcgccttagcctacctgggaagcgaaagagccattgccaccataagatccggtaagcggacattttacaccggcggaggcctgatgaccttctacttatggcggattttgtacatgtccatgatcctaagcgcacgcagcagattaaaggtgtttttcgactggattaagctggccttcttcaagagggactttttcaaaggcttatga

SEQ ID NO: 943 - DNA, 1542 bp, Artificial Sequence
  source: /note="Description of Artificial Sequence: Synthetic polynucleotide"
atgctaagcaagaacctgtatagcaacaagcggctgctgacctcgacgaacaccctagtccgcttcgcctccaccagatccaccggggtcgaaaacagcggggcaggccccacatcttttaagaccatgaaggtcattgacccccagcacagcgacaagcccaacgtgctgatactgggctcgggctggggcgctatctcgtttttaaagcacatcgacaccaagaagtacaacgtctccatcgtgagccctagaagctacttcatctttacgcccttgttaccctctgcccctgttggaaccgtggacgaaaagtccatcatcgagcccatcgttaacttcgccctcaagaaaaagggcaacgtcacctactatgaggccgaggccacctctatcaatcccgaccggaacaccgttaccatcaagtcactgagcgccgtgtcccagctgtaccaacctgagaaccacctggggctgcaccaggcagagcctgctgaaattaagtacgattatttaatcagcgctgtgggtgcggagcctaacacctttggaatccccggcgtcaccgattacggccacttcctgaaagaaatccccaacagcttggaaatccggcggacttttgccgccaacctggagaaggccaacctgttgccaaagggcgaccccgagcggagaaggctactgtccattgtggtcgtgggtggagggcccactggcgtagaggctgctggtgaactgcaggattacgtgcaccaggacctgagaaagttcctccccgccctggccgaggaaatccagattcacctggtcgaagctctgcccatcgtgttgaacatgtttgagaagaagctgtcaagctacgcccaatcacatctggaaaacacctcgatcaaggtgcatctgagaacggccgtggccaaagtggaagaaaagcagctgctggccaagaccaagcacgaggacggtaaaataaccgaggaaaccattccctacggcaccctgatttgggccaccggtaacaaggccagacccgtaatcacagacctgttcaagaagatccctgagcaaaacagctccaagcggggactggcagtgaatgacttcctgcaggtcaaaggcagcaacaacatcttcgccattggcgacaacgcctttgctggcctgcctcctacagcccaggtggcccaccaggaagccgagtatctggccaagaatttcgataagatggcccaaatccccaatttccagaagaatctgtcctcacggaaggataaaattgatctcctgttcgaggagaacaacttcaaacctttcaagtacaacgacctgggcgccctggcctacctgggaagcgaaagagccattgccaccatacgttccggtaagagaacattttacaccggcggaggcttaatgaccttctacctgtggcggatcatctacatgagcatgattctgagcgcacgcagcagactgaaggtgtttttcgactggatcaagctggcattcttcaagagggacttctttaaaggattatga

SEQ ID NO: 944 - DNA, 1542 bp, Artificial Sequence
  source: /note="Description of Artificial Sequence: Synthetic polynucleotide"
atgctgagcaagaatctgtatagtaacaagcggctgctcacctcgaccaacaccctcgtgcgcttcgctagcaccagatccaccggggtcgaaaacagcggagctggtcctaccagcttcaagaccatgaagatcattgaccctcagcacagcgacaagcccaacgtgctgatcctgggctctgggtggggagctattagctttctgaagcacatcgacaccaagaagtacaacgttagcatcgtgtctcccagaagctacttcatcttcacgcccctgctgcctagcgcaccagtgggaacagtagacgagaagtccatcatcgagcccatcgtgaacttcgccctcaagaaaaaggggaacgtcacctactacgaggccgaggccacctctatcaatcccgacaggaataccgtgaccatcaagagcctgagcgccgtgtcccagctgtaccagcccgagaaccatctgggcctgcatcaagcagagcccgccgaaattaagtacgattatctgatcagcgccgtgggcgccgagcccaacacctttggaatccccggcgtcaccgattacggccatttcctgaaggagattcccaactctttggaaatcagaagaactttcgccgccaacctggaaaaggccaacctgttgcctaagggcgatcccgagagaagaagactgctgagcatcgtggtcgtgggcggagggcccacaggcgtggaagccgctggtgaactgcaggattacgttcaccaggacctgagaaagtttctgcccgcactggccgaggaaatccaaattcacctggtggaagccctgcccatcgtgttgaatatgttcgagaaaaagctgtcatcatacgcgcagtcacatctggaaaacacctcgatcaaagtacacctgagaaccgctgtggccaaagttgaagagaagcagttgctggcaaagaccaaacacgaggacggcaaaattaccgaggaaactattccctacggcaccttgatttgggccaccggcaacaaggccagacccgtgatcaccgacctgttcaagaaaatccctgagcaaaacagcagcaagagaggcttggccgtgaacgactttttgcaagtcaaaggcagcaacaacatcttcgccatcggtgacaacgcctttgccggcttgcctcctacagcccaggtggcccaccaggaagccgagtatctggccaagaatttcgacaagatggcccaaatccccaatttccaaaagaacctatcctccagaaaggataagattgatctcctgttcgaggagaacaactttaaacccttcaagtacaacgatctgggtgccctggcatacctgggctccgaaagggccattgccaccatacgttccggtaagcggaccttctacaccggcggtggcctgatgaccttctacttatggagaattctgtacatgagcatgatcctaagcgcccgctcgagactgaaggtcttcttcgactggatcaaactggcatttttcaaaagggacttttttaaaggattatag

SEQ ID NO: 945 - DNA, 1542 bp, Artificial Sequence
  source: /note="Description of Artificial Sequence: Synthetic polynucleotide"
atgctaagcaagaacctgtacagcaacaagcggctgctgaccagcaccaacaccctcgtgcgcttcgcctccaccagatccaccggggtcgaaaacagcggagctggccccaccagcttcaagaccatgaaggtcatcgacccccagcacagcgacaagccaaacgtgctgatcctgggctctggctggggcgccatcagctttttaaagcacatcgacaccaagaagtacaacgtcagcatcatcagccccagaagctacttcctgttcacccccctgttacccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcctgagaaccacctgggcctgcaccaggccgagcccgccgagattaagtacgactacctgatcagcgctgtgggcgccgagcccaacacctttggaatccccggcgtgaccgactacggccacttcctgaaagagattcccaacagcctggaaatccggcggaccttcgccgccaacctggaaaaggccaacctgctgcctaagggcgaccccgagcggagaaggctgctgagcatcgtggtcgtgggcggaggccccacaggtgtggaagctgctggcgagctgcaggactacgtgcaccaggacctgcggaagttcctgcccgccctggccgaggaagtgcagattcacctggtggaagccctgcccatcgtgctgaacatgtttgagaagaagctgagcagctacgcccagagccacctggaaaacacctccatcaaggtgcacctgagaaccgccgtggccaaggtggaagagaagcagctgctggcaaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgactttctgcaggtcaaaggcagcaacaacatcttcgccatcggcgacaatgcctttgccggcctgcctcctacagcccaggtggcccaccaagaagccgaatatttggccaagaacttcgacaagatggcccagatccccaatttccagaagaacctgtcctcccggaaggataagatcgacctcctgttcgaggaaaacaacttcaaacccttcaagtacaacgacctgggcgccttagcctacctgggctccgaaagagccattgccaccatcagaagcggcaagcggaccttttacaccggtggtggcctgatgaccttctacctgtggcggatcctgtacttgagcatgatcctgagcgcccgcagcagactgaaggtcttcttcgactggatcaagctggccttcttcaaaagagacttcttcaagggcctgtga

SEQ ID NO: 946 - DNA, 1542 bp, Artificial Sequence
  source: /note="Description of Artificial Sequence: Synthetic polynucleotide"
atgctgagcaagaacctgtacagcaacaagcggctgctgacctcgaccaataccctcgtgcgcttcgccagcaccagatccacaggcgtcgaaaacagcggggctggccctaccagcttcaagaccatgaaggtcatcgacccccagcacagcgacaagcccaacgtgctgatcctgggctctggctggggcgccattagctttctgaagcacatcgacaccaagaagtacaacgtcagcatcatcagccctagaagctacttcctgtttacccccctgttacccagcgcccctgtgggaaccgtggacgaaaagtccattatcgagcccatcgtgaacttcgccctgaagaaaaagggcaacgtcacctactacgaggccgaagccaccagcatcaaccccgaccggaacaccgtgaccatcaaaagcctgagcgccgtgagccagctgtaccagcccgagaaccacctgggcctgcaccaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctagaaaaggccaacctgctgcctaagggcgaccccgagcggagaaggctgctgagcatcgtggtcgtgggcggagggcccacaggcgtagaagccgctggcgagctgcaggactacgtgcaccaggacctgcggaagtttctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcaactgctggccaagaccaagcacgaggacggcaagattaccgaggaaaccatcccctacggcaccctgatttgggccaccggcaacaaggccagacccgtgatcaccgaccttttcaagaagatccccgagcagaacagcagcaagcggggcctggccgtgaacgacttcctgcaagtcaaaggcagcaacaacatcttcgccatcggcgacaacgcctttgccggcctgcctccaacagcccaggtggcccaccaggaagccgagtacctggccaagaacttcgataagatggcccagatcccaaatttccagaagaacctgtcctcccggaaggataagatcgacctgctgttcgaggaaaacaacttcaagcctttcaagtacaacgatctgggcgccttagcctacctgggcagcgaaagagccattgccaccatcagaagcggcaagcggaccttctacaccggcggtggcctgatgaccttctacctgtggcggatcctgtacttgagcatgatcctgagcgcccgcagcagactgaaggtgttcttcgactggattaagctggccttcttcaagagggacttcttcaagggcctgtga

SEQ ID NO: 947 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctcgggctggggcgccatcagctttctgaagcacatcgacaccaagaagtacaacgtctccatcatcagccctagaagctacttcctgttcacccccctgctgcccagcgcccctgtgggaaccgtggacgaaaagtccatcatcgagcccatcgtgaatttcgccctgaagaaaaagggcaacgtcacctactacgaggccgaggccaccagcatcaatcccgaccggaacaccgtgaccataaagagcctgagcgccgtgagccagctgtaccagcccgagaaccacctgggcctgcaccaggccgagcccgccgagattaagtacgactacctgatcagcgccgtgggcgccgagcctaacacctttggaatccccggcgtgaccgactacggccacttcctgaaagagatccccaacagcctggaaatccggcggacctttgccgccaacctggaaaaggccaacctgttgcctaagggcgaccccgagcggagaaggctgctgagcatcgtggtcgtgggcggagggcccacaggcgtggaagctgctggcgagctgcaggattacgtgcaccaggacctgcggaagttcctgcccgccctggccgaggaagtccaaattcacctggtggaagccctgcccatcgtgctgaacatgttcgagaagaagctgagcagctacgcccagtcacacctggaaaacacctccatcaaggtgcacctgagaaccgccgtggccaaggtggaagagaagcagctgctggccaagaccaagcacgaagacggcaagattaccgaggaaaccatcccctacggcaccctgatttgggccaccggcaacaaggccagaccggtgatcaccgacctgttcaagaagatccccgagcagaacagcagcaagcggggcctggccgtgaacgacttcctgcaggtcaaaggcagcaacaacatcttcgccatcggcgacaacgcctttgctggcctgcctcctacagcccaggtggcccaccaggaagccgagtacctggccaagaacttcgacaagatggctcagatacccaatttccagaagaacctgtcctcccggaaggataagatcgacctgttgttcgaggaaaacaacttcaagcccttcaagtacaacgatttaggcgccctggcctacctgggaagcgaaagagccattgccaccatcagatccggcaagagaacattctacaccggcggaggcctgatgaccttctacctgtggagaatcctgtacctgagcatgatcctgagcgcccgcagcagactgaaggtgttcttcgactggatcaagctggccttcttcaagagagacttcttcaagggcctgtga

SEQ ID NO: 948 - DNA, 1542 bp, Artificial Sequence
  source: /note="Description of Artificial Sequence: Synthetic polynucleotide"
atgctgagcaagaacctgtatagcaacaagcggctgctcaccagcaccaataccctcgtgcgcttcgccagcaccagatccaccggcgtcgaaaacagcggggctggccccaccagcttcaagaccatgaaggtcatcgacccccagcacagcgacaagcccaacgtgctgatcctgggttctggctggggcgccatcagctttctgaagcacatcgacaccaagaagtacaacgtcagcatcatcagccccagaagctacttcctgttcacccccctgttacccagcgcccctgtgggaaccgtggacgagaagtccatcatcgagcccatcgtgaacttcgccctgaagaaaaagggcaacgtcacctactacgaggccgaggccaccagcatcaatcccgaccggaacaccgtgaccatcaagagcctgagcgccgtgtcccagctgtaccagcccgagaaccacctggggctgcaccaggccgagcccgccgagattaagtacgactacctgatcagcgccgtgggcgcggagcccaacacctttggaatccccggcgtgaccgattacggccacttcctgaaagagatccccaacagcctggaaatccggcggaccttcgccgccaacctggaaaaggccaacctgttgcctaagggcgaccccgagcggagaaggctgctgagcattgtcgtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccatctggaaaacacctccatcaaggtgcatctgagaaccgccgtggccaaagtggaagagaagcagctgctggccaagaccaaacacgaagacggcaagataaccgaggaaactatcccctacggcaccctgatttgggccaccggcaacaaggccagaccggtgatcaccgacctgttcaagaagatccccgagcagaacagcagcaagcggggactggccgtgaacgacttcctgcaggtcaaaggcagcaacaacattttcgccatcggcgacaatgcctttgccggcctgccacctacagcccaggtggcccaccaggaagccgagtacctggccaagaatttcgacaagatggcccagatccccaatttccagaagaacctgtcctcccggaaggataagatcgacctgctgttcgaggagaacaacttcaagcccttcaagtacaacgacctgggcgccctggcatacctgggcagcgaaagagccattgccaccatcagaagcggcaagcggaccttctacaccggcggaggcctgatgaccttctacctgtggagaatcctgtacctgtccatgatcctgagcgcccgcagcagactgaaggtgttcttcgactggatcaagctggccttcttcaagagggacttcttcaagggcctgtag

SEQ ID NO: 949 - DNA, 1542 bp, Artificial Sequence
  source: /note="Description of Artificial Sequence: Synthetic polynucleotide"
atgctgtcgaagaacctgtacagtaacaagcggctgctgaccagcaccaacaccctcgtgagattcgccagcaccagatccaccggcgtggaaaacagcggggctggccctacctctttcaagaccatgaaggtcatcgacccccagcacagcgacaagcccaacgtgctgatcctgggctctggctggggagccatcagctttctgaagcacatcgacaccaagaagtacaacgtcagcatcatcagccccagaagctacttcctgttcacccccctgctgcccagcgccccagtggggaccgtggacgagaagtcaatcatcgagcccatcgtgaatttcgccctcaagaaaaagggcaacgtcacctactatgaggccgaggccaccagcatcaatcccgaccggaacaccgttaccatcaagagcctgagcgccgtgtcccagctgtaccagcccgagaaccacctgggcctgcaccaggccgagcccgctgagattaagtacgactacctgatcagcgccgtgggcgccgaacccaacacctttggaatccccggcgtgaccgactacggccacttcctgaaagagatccccaacagcctggaaatccggagaaccttcgccgccaacctggagaaggctaacctgctgcctaagggcgaccccgagcggagaaggctgctgagcatcgtggtcgtgggcggaggccccacaggcgtggaagctgctggcgagctgcaggactacgtgcaccaggacctgagaaagttcctgcccgccctggccgaggaagtgcagattcacttggtggaagccctgcccatcgtgctgaacatgttcgagaagaagctgagcagctacgcccagagccacctggaaaacacctccatcaaggtgcacctgagaacggccgtggccaaagtggaagagaagcagctgctggccaagaccaagcacgaagacggcaaaattaccgaggaaaccatcccctacggcactctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaatttcgacaagatggcccagatccccaatttccagaagaacctgtcctcccggaaggataagatcgacctcctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacctgagcatgatcctgagcgcccgcagcagactgaaggtgttcttcgactggatcaaactggccttcttcaagagggacttcttcaagggcctgtga

SEQ ID NO: 950 - DNA, 1542 bp, Artificial Sequence
  source: /note="Description of Artificial Sequence: Synthetic polynucleotide"
atgctaagcaagaacctgtacagcaacaagaggctgctgaccagcaccaacaccctcgtgcgcttcgccagcaccagatccaccggcgtcgaaaacagcggggctggtcccaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgttcacccccctgttacccagcgcccctgtgggaaccgtggacgaaaagtccatcatcgagcccatcgttaacttcgccctgaagaaaaagggcaacgtcacctactacgaggccgaagccaccagcatcaaccccgaccggaacaccgtgaccatcaagagcctgagcgccgtgtcccagctgtaccaacccgagaaccacctaggcctgcaccaggccgagcccgccgagattaagtacgactacctgatcagcgccgtgggcgccgagcccaacacctttggaatccccggcgtgaccgactacggccacttcctgaaagagatccccaactctctggaaatccggcggaccttcgccgccaatctggaaaaggccaacttactgcctaagggcgatcccgagcggagaaggctgctgagcatcgtggtcgtgggcggaggccccacaggcgtggaagctgctggcgagctgcaggactacgtgcaccaggacctgcggaagtttctgcccgcactggccgaggaagtgcagattcacctggtggaagccctgcccatcgtgctgaacatgttcgagaagaagcttagcagctacgcccagagccacctggaaaacacctccatcaaggtgcacctgagaaccgccgtcgccaaggtggaagagaagcagctgctggcaaagaccaagcacgaggacggcaagattaccgaggaaaccattccctacggtaccctgatttgggccaccggcaacaaggccagacccgtgatcaccgacctgttcaagaagatccctgagcagaactcgagcaagagaggcctggccgtgaatgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatacccaatttccagaagaacctgtcctcccggaaggataagatcgacctgctgttcgaggaaaacaacttcaagcccttcaaatacaacgacctgggcgccctggcctacctgggctccgaaagagccattgccaccatcagaagcggcaagcggaccttctacaccggcggaggcctgatgaccttctacctgtggcggatcttgtacctgagcatgattctgagcgcccgcagcagactgaaggtgttcttcgactggatcaagctggccttcttcaagagggacttcttcaagggactgtga

SEQ ID NO: 951 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggcaggtcccaccagcttcaagaccatgaaggtcatcgacccccagcacagcgacaagcccaacgtgctgatactgggctctggctggggcgccatctcgtttctgaagcacatcgacaccaagaagtacaacgtcagcatcatctctcccagaagctacttcttattcacccccctgctgcccagcgcacctgtgggaaccgtggacgagaagtccatcatcgagcccatcgtgaacttcgccctgaagaaaaagggcaacgttacctactatgaggccgaggccaccagcatcaaccccgaccggaacaccgttaccatcaagagcctgagcgccgtgtcccagctataccagcccgagaaccacctgggcctgcaccaggccgagcccgccgagattaagtacgactacctgatcagcgctgtgggcgccgagcccaacacctttggaatccccggcgtcaccgactacggccacttcctgaaagagatccccaacagcctggaaatccggagaaccttcgccgccaacctggaaaaggccaacctgctgcctaagggcgaccccgagcggagaaggctgctgagcatcgtggtcgtgggcggaggccccactggcgtggaagctgctggcgagctacaggattacgtgcaccaggacctgcggaagttcctgcccgccctggccgaggaagtgcaaattcacctggtggaagccctgcccatcgtgctgaacatgttcgagaagaagctgagcagctacgcccagagccacctggaaaacacctccatcaaggtgcacctgagaaccgccgtggccaaggtggaagagaagcaactgctggccaagaccaagcacgaggacggcaagattaccgaggaaaccatcccctacggcaccttgatttgggccaccggcaacaaggccagaccggtgatcaccgacctgttcaagaagatccccgagcagaacagcagcaagcggggcctggccgtgaacgacttcttgcaggtcaaaggcagcaacaacatcttcgccatcggcgacaacgcctttgccggcctgcctccaacagcccaggtggcccaccaggaagccgagtacctggccaagaacttcgacaagatggcccagatccccaatttccagaagaacctgtcctcccggaaggataagatcgacctgctgttcgaggaaaacaactttaagcccttcaagtacaacgatctgggcgccttagcctacctgggcagcgaaagagccattgcaaccatcagaagcggcaagcggaccttctacaccggcggaggcctgatgaccttctacctgtggcggatcctgtacctgagcatgatcctaagcgccagaagcagactgaaggtgttcttcgactggatcaagctggccttcttcaagagggacttcttcaagggcctgtag

SEQ ID NO: 952 - DNA, 1542 bp, Artificial Sequence
  source: /note="Description of Artificial Sequence: Synthetic polynucleotide"
atgctgagcaagaacctgtatagcaacaagcggctgctgaccagcaccaacaccctcgtgcgcttcgccagcaccagatccaccggggtcgaaaacagcggggctggccccacctctttcaagaccatgaaggtcatcgacccccagcacagcgacaagcccaacgtgctgatcctgggttctggctggggagccattagctttctgaagcacatcgacaccaagaagtacaacgttagcatcatcagccccagaagctacttcctgttcacccccctgctgccctctgcacctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgtctgccgtgtcccagctgtaccagcccgaaaaccacctgggcctgcaccaggccgagcccgccgagattaagtacgactacctgatcagcgccgtgggcgccgagcccaacacctttggaattcccggcgtgaccgactacggccacttcctgaaagagatccccaacagcctggaaatccggcggaccttcgccgccaacctggaaaaggccaacttactgcctaagggcgaccccgagcggagaaggctgctgtccatcgtggtcgtgggcggaggccccactggcgtggaagctgctggcgaactgcaggactacgtgcaccaggacctgcggaagttcctgcccgccctggccgaggaagtgcagattcacctggtggaagccctgcccatcgtgctgaacatgtttgagaagaagctgagcagctacgcccagagccacctggaaaacacctccatcaaggtgcacctgagaaccgccgtcgccaaggtggaagagaagcagctgttggccaagaccaagcacgaggacggcaagattaccgaggaaaccatcccctacggcaccctgatttgggccaccggtaacaaggccagacccgtgatcaccgacctgttcaagaagattcccgagcaaaacagcagcaagcggggcctggccgtgaacgacttcctgcaagtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctgtcctccagaaaggataagattgacctgctgttcgaggaaaacaacttcaagcccttcaagtacaacgatctgggcgccctggcctacctgggcagcgaaagagccattgccaccatcagatccggtaagcggaccttttacaccggcggaggcctgatgaccttctacctgtggcggatcctgtacctgagcatgatcctgagcgcccgcagcagactgaaggtgtttttcgactggatcaagctggccttcttcaagagggacttcttcaagggcctgtga

SEQ ID NO: 953 - DNA, 1542 bp, Artificial Sequence
  source: /note="Description of Artificial Sequence: Synthetic polynucleotide"
atgctgagcaagaacctgtacagcaacaagcggctgctgacctcgaccaacaccctcgtgcgcttcgccagcaccagatccaccggggtcgaaaactccggggcaggccccaccagcttcaagaccatgaaggtcatcgaccctcagcacagcgacaagccaaacgtgctgatcctgggctctggctggggcgctatcagctttttaaagcacatcgacaccaagaagtacaacgtcagcatcatcagccctagaagctatttcctgttcacccccctgttacccagcgcccctgtggggaccgtggacgagaagtccatcatcgagcccatcgttaacttcgctctgaagaaaaagggcaacgtcacctactacgaggccgaggccaccagcatcaaccccgaccggaacaccgtgaccatcaaaagcctgagcgccgtgtcccagctgtaccagcccgagaaccacctgggcctgcaccaggccgagcccgccgagattaagtacgattacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctacaggactacgtgcaccaggacctgcggaagttcctgcccgcactggccgaggaagtgcagattcacctggtggaagccctgcccatcgtgctgaacatgttcgagaagaagctgagcagctacgcccagagccacctggaaaacacctccatcaaggtgcacctgagaaccgccgtcgccaaggtggaagagaagcagctgctggccaagaccaaacacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacttggccaagaactttgacaagatggcccagatccccaatttccagaagaacctgtcctcccggaaggataagatcgatctgctgttcgaggaaaacaacttcaaacccttcaagtacaacgacttaggcgccctggcctacctgggcagcgaaagagccattgccaccatccgtagcggtaagcggacattctacaccggcggaggcctgatgaccttctacctgtggcggatcctgtacctgagcatgatcctgagcgcccgcagcagactgaaggtgttcttcgactggatcaagctggccttcttcaagagggactttttcaagggcctgtag

SEQ ID NO: 954 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggggtggaaaacagcggggctggccccaccagcttcaagaccatgaaggtcatcgacccccagcacagcgacaagcccaacgtgctgatcctgggctctggctggggcgccatctcgtttctgaagcacatcgacaccaagaagtacaacgtcagcatcatcagccccagaagctacttcttattcacccccctgctgcccagcgcccctgtgggaaccgtggacgagaagtcaatcatcgagcccatcgtgaacttcgccctgaagaaaaagggcaacgtcacctactacgaggccgaggccaccagcatcaatcccgacaggaacaccgtgaccatcaagagcctgagcgccgtgtcccagctataccagcccgagaaccacctgggcctgcaccaggccgagcccgccgagattaagtacgactatctgatcagtgccgtgggcgccgagcccaacacctttggaatccccggcgtgaccgactacggtcacttcctgaaagagatccccaacagcctggaaatccggcggaccttcgccgccaacctggaaaaggccaacctgctgcctaagggtgaccccgagcggagaaggctgctgagcatcgtcgtcgtgggcggaggccccacaggcgtggaagctgctggcgagctgcaggactacgtgcaccaggacctgcggaagttcctgcccgccctggccgaggaagtgcagattcacctggtggaagccctgcccatcgtgctgaacatgttcgagaagaagctgagcagctacgcccagagccacctggaaaacacctcgatcaaggtgcacctgagaaccgccgtggccaaggtggaagagaagcaactgctggccaagaccaagcacgaggacggcaaaattaccgaggaaaccatcccctacggtactttgatttgggccaccggcaacaaggccagacccgtgatcaccgacctgttcaagaagatccccgagcagaacagctccaagcggggcctggcagtgaacgacttcctgcaggtcaaaggcagcaacaacatcttcgccatcggcgacaacgcctttgccggcctgcctcctacagcccaggtggcccaccaggaagccgagtacctggccaagaacttcgacaaaatggcccagatacccaatttccagaagaacctatcctcccggaaggataagatcgacctgctgttcgaggaaaacaacttcaagcccttcaagtacaacgacttaggcgccctggcctacctgggcagcgaaagagccattgccaccataagaagcggcaagcggaccttctacaccggcggaggcttaatgaccttctacctgtggcggatcctgtacctgagcatgattctgagcgcccgcagcagactgaaggtgttcttcgactggatcaagctggccttcttcaagagggactttttcaagggcctgtag

SEQ ID NO: 955 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccacaggcgtcgaaaacagcggggctggccccaccagcttcaagaccatgaaggtcatcgacccccagcacagcgacaaacccaacgtgctgatcctgggctctggctggggcgccatcagctttctgaagcacattgacaccaagaagtacaacgtcagcatcatcagccccagaagctacttcctgttcacccccctgctgcccagcgcccctgtgggaaccgtggacgagaagtccattatcgagcccatcgtgaacttcgctctgaagaaaaagggcaacgtcacctactatgaggccgaggccacctctatcaatcccgaccggaacaccgtgaccatcaagagcctgagcgccgtgtcccagctgtaccaacccgagaaccatctgggcctgcatcaggccgagcccgccgagattaagtacgactatctgatcagcgccgtgggcgccgagcccaacacctttggaatccccggcgtgaccgactacggccacttcctgaaagagatccccaacagcctggaaatcagacggaccttcgccgccaacctggaaaaggccaacctgctgcctaagggcgaccccgagcggagaaggctgctgagcatcgtggtcgtgggcggaggccccacaggcgtggaagctgctggcgaactgcaggactacgtgcaccaggacctgcggaagtttctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagttgctggcaaagaccaagcacgaggacggcaagataaccgaggaaaccatcccctacggcactctgatttgggccacgggcaacaaggccagacccgtgatcaccgacctgttcaagaagatccctgagcagaacagcagcaagcggggactggccgtgaacgacttcctgcaggtcaaaggcagcaacaacatcttcgccatcggcgacaacgcctttgctggcctgcctcctacagcccaggtggcccaccaggaagccgagtacctggccaagaacttcgacaagatggctcagatccccaatttccagaagaacctgtcctcccggaaggataagatcgacctgctgttcgaggaaaacaacttcaaacccttcaagtacaacgacctgggcgccctggcctacctgggcagcgaaagagccattgccaccatcagaagcggcaagcggaccttctacaccggcggaggcctgatgaccttctacctgtggcggattatctacctgagcatgattctgtctgcccgcagcagactgaaggtgttcttcgactggatcaagctggccttcttcaaaagggacttcttcaagggactgtga

SEQ ID NO: 956 - DNA, 1542 bp, Artificial Sequence
  source: /note="Description of Artificial Sequence: Synthetic polynucleotide"
atgctgagcaagaacctgtacagcaacaagcggctgctgaccagcaccaacacgctcgtgcgcttcgccagcaccagatccaccggcgtcgaaaacagcggggctggccccaccagcttcaagaccatgaaggtcatcgacccccagcacagcgacaagcccaacgtgctgatactgggctcgggctggggagctatcagctttctgaagcacatcgacaccaagaagtacaacgtcagcatcatctctcccagaagctacttcctgttcacccccctgctgcccagcgcccctgtgggaaccgtggacgagaagtccatcatcgagcccatcgtgaactttgccctgaagaaaaagggcaacgtcacctactatgaggccgaggccaccagcatcaaccccgaccggaacaccgtgaccatcaagagcctgagcgccgtgtcccagctgtaccagcccgagaaccacctgggcctgcatcaggccgagcccgccgagattaagtacgactacctgatcagcgctgtgggcgcggagcccaacacctttggaatccccggcgtgaccgactacggccacttcctgaaagagatccccaacagcctggaaatccggagaaccttcgccgccaacctggaaaaggccaacctgctgcctaagggcgaccccgagagaagaaggctgctgagcatcgtggtcgtgggcggaggccccacaggcgtggaagctgctggcgagctgcaggactacgtgcaccaggacctgcggaagttcctgcccgccctggccgaggaagtgcaaattcacttggtggaagccctgcccatcgtgctgaacatgttcgagaagaagctgagcagctacgcccagagccatctggaaaacacctccatcaaggtgcacctgagaaccgccgtggccaaggtggaagagaagcagctgctggccaagacgaagcacgaggacggcaagattaccgaggaaaccatcccctacggcaccctgatttgggccaccggtaacaaggccagacccgtgatcaccgacctgttcaagaagatccccgagcagaacagcagcaagcggggcctggccgtgaacgacttcctgcaagtcaaaggcagcaacaacattttcgccatcggcgacaacgcctttgccggcctgcctcctacagcccaggtggcccaccaggaagccgagtacttggccaagaacttcgacaagatggcccaaatccccaatttccagaagaacctgtcctcccggaaggataagatcgacctcctgttcgaggaaaacaacttcaagcccttcaagtacaacgacctgggcgccctggcatacctgggcagcgaaagagccattgccaccatcagaagcggcaagcggacattttacaccggcggtggcctgatgaccttctacctgtggcggatcctgtacatgagcatgatcctgtctgcccgcagcagactgaaggtgttcttcgactggatcaagctggccttcttcaagagggacttctttaagggactgtga

SEQ ID NO: 957 - DNA, 1542 bp, Artificial Sequence
  source: /note="Description of Artificial Sequence: Synthetic polynucleotide"
atgctgagcaagaacttgtacagcaacaagcggttgctgaccagcaccaacaccctcgtgcgcttcgccagcaccagatccaccggcgtcgaaaacagcggggctggccccacaagctttaagaccatgaaagtcatcgaccctcagcacagcgacaagcccaacgtgctgatcctgggctctggctggggcgccattagctttctgaagcacatcgacaccaagaagtacaacgtcagcatcatcagccccagaagctacttcctgttcacccccctgttacccagcgcccctgttggaaccgtagacgaaaagtccatcatcgagcccatcgtgaacttcgccctcaagaaaaagggcaacgtcacctactacgaggccgaggccaccagcatcaaccccgaccggaacaccgtgaccatcaagtcactgagcgccgtgtcccagctgtaccagcccgagaaccacctgggcctgcaccaagccgagcccgccgagattaagtacgactacctgatcagcgccgtgggcgccgaacctaacacctttggaatccccggcgtgactgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcctgccctggccgaagaaatccagattcacctggtggaagctctgcccatcgtgctgaacatgttcgagaagaagctgagcagctacgcccaaagccacctggaaaacacctccatcaaggtgcacctgagaaccgccgtcgccaaggtggaagagaagcagctgctggccaagaccaagcacgaggacggcaagattaccgaagaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgctggcctgcctcctacagcccaggtggcgcaccaggaagccgaatacctggccaagaacttcgacaagatggcccagatccccaatttccagaagaacctgtcctcccggaaggataagatcgacctgttgttcgaggaaaacaacttcaagcccttcaagtacaacgacctgggcgccctggcctacctgggcagcgaaagagccattgccaccatcagatccggcaagagaaccttctacaccggcggaggcctgatgaccttctacctgtggcggatcttgtacctgagcatgatcctgagcgcccgcagcagactgaaggtgttcttcgactggatcaagctggccttcttcaagagggacttcttcaagggcctgtga

SEQ ID NO: 958 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccacctctttcaagaccatgaaggtcatcgacccccagcacagcgacaagcccaacgtgctgatcctgggttctggctggggcgccatcagctttctgaagcacattgacaccaagaagtacaacgtcagcatcatcagccccagaagctacttcctgtttacgcccctgctgcccagcgcccctgtgggaaccgtggacgagaagtccatcattgagcccatcgttaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcatcaggccgaacccgccgagattaagtacgactacctgatcagtgccgtaggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccttggccgaggaagtgcagattcacctggtggaagccctgcccatcgtgctgaatatgttcgagaagaagctgagcagctacgcccagagccacctggaaaacacttcgatcaaggtgcacctgagaaccgccgtggccaaggtggaagagaagcagctgctggccaagaccaagcacgaggacggcaagataaccgaggaaactatcccatacggcaccctgatttgggccaccggcaacaaggccagacccgtgatcaccgacctgttcaagaagatccctgagcagaactcgagcaagcggggcctggcagtgaacgacttcctgcaggtcaaaggcagcaacaacatcttcgccatcggcgacaacgcctttgccggcctgcctcctacagcccaagtggcccaccaggaagccgaatacctggccaagaacttcgacaagatggcccagatcccaaatttccagaagaatctgtcctcccggaaggataagatcgacctgctgttcgaggaaaacaacttcaagcctttcaagtacaacgacctgggcgccctggcctacctgggcagcgaaagagccattgccaccatcagaagcggcaagcggaccttctacaccggcggaggcttaatgaccttctacctgtggcggatcatctacctgtccatgatcctgagcgcccgcagcagactgaaggtgttcttcgactggatcaagctggcattcttcaagagggacttctttaagggcctgtga

SEQ ID NO: 959 - DNA, 1542 bp, Artificial Sequence
  source: /note="Description of Artificial Sequence: Synthetic polynucleotide"
atgctatcgaagaacctgtacagcaacaagcggctgctgaccagcaccaacaccctcgtgcgcttcgccagcaccagatccaccggcgtcgaaaacagcggggctggccctaccagcttcaagaccatgaaagtcatcgaccctcagcacagcgacaagcccaacgtgctgatcctgggctctggctggggcgccatcagctttctgaagcacatcgacaccaagaagtacaacgtcagcatcatcagccccagaagctacttcctgttcacccccttgctgccctctgcacctgtgggaaccgtggacgagaagtccatcatcgagcccatcgtgaacttcgccctgaagaaaaagggcaacgtcacctactatgaggccgaggccaccagcatcaaccccgaccggaacaccgtgaccatcaagagcctgagcgccgtgtcccagctataccagcccgagaaccacctgggcctgcatcaggccgagcccgccgagattaagtacgactacctgatcagcgccgtgggcgccgagcccaacacctttggaatccccggcgtgactgactacggccacttcctgaaagagatccccaacagcctggaaatccggcggaccttcgccgccaacctggaaaaggccaacctgctgcctaagggcgaccccgagcggagaaggctgctgagcatcgtcgtcgtgggcggaggccccacaggtgtggaagctgctggcgagctacaggattacgtgcaccaggacctgcggaagttcctgcccgccctggccgaggaagtgcagattcacctggtggaagccctgcccatcgttctgaacatgttcgagaagaagctgagcagctacgcccagtcacatctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaatgactttctgcaggtcaaaggcagcaacaacattttcgccatcggtgacaacgcctttgccggcctgccacctaccgcccaggtggcccaccaggaagccgagtacctggccaagaatttcgacaagatggcccagatccccaatttccagaagaacctgtcctcccggaaggataagatcgacctgctgttcgaggaaaacaacttcaagcccttcaagtacaacgacctgggcgccctggcctacctgggcagcgaaagagccattgcaaccatcagaagcggcaagcggaccttctacaccggcggaggcctgatgaccttctacctgtggcggatcatctacctgagcatgatcctgagcgcccgcagcagactgaaggtgttcttcgactggatcaagttagccttcttcaagagggacttctttaagggactgtga

SEQ ID NO: 960 - DNA, 1542 bp, Artificial Sequence
  source: /note="Description of Artificial Sequence: Synthetic polynucleotide"
atgctgagcaagaacctgtacagcaacaagcggctgctgaccagcacgaacacgctagtgagattcgccagcaccagatccaccggcgtcgaaaacagcggggctggtcccaccagcttcaagaccatgaaggtcatcgaccctcagcacagcgacaagcccaacgtgctgatcctgggctctggctggggcgccattagctttctgaagcacatcgacaccaagaagtacaacgtcagcatcatcagccccagaagctacttcctgttcacccccctgctgccctctgcacctgtggggaccgtagacgagaagtccatcatcgagcccatcgtgaacttcgccctgaagaaaaagggcaacgtcacctactacgaggcagaggccaccagcatcaaccccgacaggaacaccgtgaccatcaagagcctgagcgccgtttcccagctgtaccagcccgagaaccacctgggcctgcaccaggccgagcccgccgaaattaagtacgactacctgatcagcgccgtgggcgccgagcccaacacctttggaatccccggcgtgaccgactacggccacttcctgaaggagattcccaacagcctggaaatccggcggaccttcgccgccaacctggaaaaggctaacctgctgcctaagggcgatcccgagcggagaaggctgctgagcatcgtggtcgtgggcggaggccccacaggcgtggaagctgctggcgagctgcaggactacgtgcaccaggacctgcggaagttcctgcctgccctggccgaagaagtgcagattcacctggtggaagctctgcccatcgtgctgaacatgttcgagaagaagctgagcagctacgcgcagagccacctggaaaacacctccatcaaggtgcacctgagaaccgccgtggccaaggtggaagagaagcagctgctggccaagaccaagcacgaggacggcaagattaccgaggaaaccatcccctacggcactctgatttgggccaccggcaacaaggccagacccgtgatcaccgacctgttcaagaagatccccgagcagaacagctccaagcggggcctggccgtgaacgacttcctgcaggtcaaaggcagcaacaacatcttcgccatcggcgacaacgcctttgccgggctgcctcctacagcccaggtggcccaccaggaagccgagtacctggccaagaacttcgataagatggcccagatccccaatttccagaagaacctgtcctccagaaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcacgcagcagactgaaggtgttcttcgactggatcaagctggcctttttcaagagggacttcttcaagggcctgtga

SEQ ID NO: 961 - DNA, 1542 bp, Artificial Sequence
  source: /note="Description of Artificial Sequence: Synthetic polynucleotide"
atgctgagcaagaatctgtacagcaacaagcggctgctgaccagcaccaataccctcgtgcgcttcgcctccaccagatccaccggcgtcgaaaacagcggggctggccccaccagcttcaagaccatgaaggtcatcgacccccagcacagcgacaaacccaacgtgctgatcctgggctctgggtggggcgccatcagctttttaaagcacatcgacaccaagaagtacaacgtcagcatcatcagccctagaagctacttcatcttcacccccctgctgccttctgcccctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccatctgggcctgcatcaggccgagcctgccgagattaagtacgactacttaatcagcgccgtaggcgccgagcccaacacctttggaatccccggcgtcaccgactacggccacttcctgaaagagattcccaacagcctggaaataagacggaccttcgccgccaacctggaaaaggccaacctgctgcctaagggtgaccccgagcggagaaggctgctgagcatcgtggtcgtgggcggaggccccacaggcgtggaagctgctggcgagctgcaggactacgttcaccaggacctgcggaagttcctgcccgccctggccgaggaagtgcagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtaatcaccgacctgttcaagaagatccccgagcagaacagcagcaagcggggattggccgtgaacgacttcctgcaggtcaaaggcagcaacaacattttcgccatcggcgacaacgcctttgccggcctgccacctacagcccaggtggcccaccaggaagccgagtacttggccaagaacttcgacaagatggcccagatccccaatttccagaagaatctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggtggcctgatgaccttctacctgtggcggatcctgtacctgagcatgatcctgagcgcccgctcgagactgaaggtcttcttcgactggatcaagctggccttcttcaagagggacttcttcaagggcctgtga

SEQ ID NO: 962 - DNA, 1542 bp, Artificial Sequence
  source: /note="Description of Artificial Sequence: Synthetic polynucleotide"
atgctgagcaagaacctgtacagcaacaagcggttgctcaccagcaccaacaccctcgtgagattcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcatcagccccagaagctacttcctgtttacccccctgctgccctctgcacctgtgggaaccgtggacgagaagtccatcatcgagcccatcgttaacttcgccctgaagaaaaagggcaacgtcacctactatgaggccgaggccaccagcatcaaccccgaccggaataccgtgaccatcaagagcctgagcgccgtgagccagctgtaccagcccgagaaccatctgggcctgcaccaggccgagcccgccgagattaagtacgactacctgatcagcgccgtgggcgccgagcccaacacctttggaatccccggcgtgactgactacggccacttcctgaaagagatccccaacagcttggaaatccggcggaccttcgccgccaacctggagaaggccaacctgctgcctaagggcgaccccgagcggagaaggctgctgagcattgtggtcgtgggcggaggccccacaggcgtggaagctgctggtgagctgcaggactacgtgcaccaggacctgcggaagtttctgcctgccctggccgaggaagtgcaaattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccacgggcaacaaggccagacccgtgatcaccgacctgttcaagaagatccccgagcagaacagcagcaagagaggcctggccgtgaacgacttcctgcaggtcaaaggcagcaacaacatcttcgccatcggcgacaacgcatttgctggcctgcctcctacagcccaggtggcccaccaagaagccgagtatttggccaagaacttcgacaagatggcccagatccccaatttccagaagaacctgtcctcccggaaggataagatcgacctgctgttcgaggaaaacaactttaagcccttcaagtacaacgacctgggtgccctggcctacctgggcagcgaaagagccattgccaccatcagaagcggcaagcggaccttctacaccggcggaggcttaatgaccttctacctgtggcggatcctgtacctgagcatgatcctgagcgcacgcagcagactgaaggtgttcttcgactggatcaagctggccttcttcaagagggacttcttcaagggcctgtga

SEQ ID NO: 963 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggcaggccccacaagcttcaagaccatgaaggtcatcgacccccagcacagcgacaagcccaacgtgctgatcctgggctctggctggggcgccatctcgtttctgaagcacatcgacaccaagaagtacaacgtcagcatcatcagccccagaagctacttcctgttcacccccctgctgcccagcgcccctgtgggaaccgtggacgagaagtccatcatcgagcccatcgtgaacttcgccctgaagaaaaagggcaacgttacctactacgaggcagaggccaccagcatcaaccccgaccggaacaccgtgaccatcaagtcattaagcgccgtgtcccagctgtaccagcccgaaaaccacctgggcctgcaccaggccgagcccgccgagattaagtacgactacctgatcagcgccgtaggcgccgagcctaacacctttggaatccccggcgtgaccgactacggccacttcctgaaagagatccccaacagcctggaaatccggcggacctttgccgccaacctggaaaaggccaacctgctgcctaagggcgaccccgagagaagaaggctgctgagcatcgtcgtcgtgggcggaggccctacaggcgtggaagctgctggcgagctgcaggactacgtgcaccaggacctgcggaagtttctccccgccctggccgaggaaatccagattcacttggtggaagccctgcccatcgttctgaacatgttcgagaagaagctgagcagctacgcccagagccacctggaaaacacctccatcaaggtgcacctgagaaccgccgtggccaaagtggaagagaagcagctgctggccaagaccaagcacgaagacggcaagattaccgaggaaaccatcccctacggcaccctgatttgggccaccggcaacaaggccagacccgtgatcaccgacctgttcaagaagatccccgagcagaacagcagcaagcggggcctggccgtgaatgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatcccaaatttccagaagaatctgtcctcccggaaggataagattgacctgctgttcgaggaaaacaacttcaagcccttcaagtacaacgacctgggcgccctggcctacctgggcagcgaaagagccattgccaccataagaagcggcaagagaaccttctacaccggcggaggcttaatgaccttctacctgtggcggatcctgtacctgagcatgatcctgagcgcccgcagcagactgaaggtcttcttcgactggatcaagctggccttcttcaagagggacttcttcaagggactgtag

SEQ ID NO: 964 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtccgcttcgccagcaccagatccaccggcgtcgaaaactccggggctggccccaccagcttcaagaccatgaaggtcatcgacccccagcacagcgacaagcccaacgtgctgatcctgggctctgggtggggagccatcagctttctgaagcacatcgacaccaagaagtacaacgtcagcatcatcagccccagaagctacttcatcttcacccccctgctgcccagcgcccctgtgggaacagtagacgagaagtccatcatcgagcccatcgtgaacttcgccctgaagaaaaagggcaacgtcacctactatgaggccgaggccaccagcatcaaccccgaccggaacaccgtgaccatcaagagcctgagcgccgtgtcccagctataccagcccgagaaccacctgggcctgcaccaggccgagcccgccgagattaagtacgactacctgatcagcgccgtaggcgccgagcccaacacctttggaatccccggcgtgaccgactacggccacttcctgaaagagatccccaacagcctggaaatccggcggaccttcgccgccaacctggaaaaggccaacctgctgcctaagggcgatcccgagcggagaaggctgctgagcatcgtggtcgtgggcggtggccccacaggcgtggaagccgctggcgaactgcaggactacgtgcaccaggacctgcggaagttcctgcccgccctggccgaggaagtccagattcacctggtggaagccctgcccatcgtgctgaacatgttcgagaagaagctgagcagctacgcccaaagccacctggaaaacacctcgatcaaagtgcacctgagaaccgccgtggccaaggtggaagagaagcagctgctggccaagaccaagcacgaggacggcaagattaccgaggaaaccatcccctacggcaccctgatttgggccaccggtaacaaggccagacccgtgatcaccgacctgttcaagaagatccccgagcagaacagcagcaagcggggcctggccgtgaacgactttttgcaagtgaaaggcagcaacaacatcttcgccatcggcgacaacgcctttgccgggttgcctcctacagcccaggtggcccaccaggaagccgagtacctggccaagaactttgacaagatggcccagatccccaatttccagaagaacctgtcctcccggaaggataagatcgacctgctgttcgaggagaacaacttcaagcccttcaagtacaacgacctgggcgccctggcctacctgggcagcgaaagagccattgccaccataagaagcggcaagcggaccttctacaccggcggaggcctgatgaccttctacctgtggcggatcctgtacctgagcatgatcctgagcgcccgcagcagactgaaggtcttcttcgactggatcaagctggccttcttcaagagagacttcttcaagggactgtga

SEQ ID NO: 965 - DNA, 1542 bp, Artificial Sequence
  source: /note="Description of Artificial Sequence: Synthetic polynucleotide"
atgctgagcaagaacctgtacagcaacaagcggctgctgacctcgaccaacaccctcgtgcgcttcgccagcaccagatccaccggcgtcgaaaacagcggggctggccccaccagctttaagaccatgaagatcatcgacccccagcacagcgacaagcccaacgtgctgatcctgggctctggctggggcgccatcagctttctgaagcacatcgacaccaagaagtacaacgttagcatcatcagccccagaagctacttcctgttcacccccctgctgcccagcgccccagttgggaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggtgccgagcccaacacctttggaattcccggcgtgaccgactacggccacttcctgaaagagatccccaacagcctggaaatccggcggaccttcgccgccaacctggaaaaggccaacttactgcctaagggcgaccccgagcggagaaggctgctgagcatcgtggtcgttggcggtgggcccacaggtgtggaagctgctggcgagctgcaggactacgtgcaccaggacctgcggaagttcctgcctgccctggccgaggaagtgcagattcacctggtcgaagccctgcccatcgtgctgaacatgttcgagaagaagctgtcatcatacgcccagagccacctggaaaacacctccatcaaggtgcatctgagaaccgctgtggccaaggtggaagagaagcagctgctggccaagaccaaacacgaggacggcaaaattaccgaggaaactatcccctacggcaccctgatttgggccaccggcaacaaggccagacccgtgatcaccgacctgttcaagaagatccccgagcagaacagcagcaagcggggcttggccgtgaacgacttcctgcaggtcaaaggcagcaacaacatcttcgccatcggcgacaacgcctttgccggcctgcctcctacagcccaggtggcccaccaggaggccgaatacctggccaagaacttcgacaaaatggcccaaatccccaatttccaaaagaacctgtcctcccggaaggataagatcgacctgctgttcgaggagaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagttagccttcttcaagagggacttcttcaagggcctgtga

SEQ ID NO: 966 - DNA, 1542 bp, Artificial Sequence
  source: /note="Description of Artificial Sequence: Synthetic polynucleotide"
atgctgagcaagaacctgtacagcaacaagcggctgctgaccagcaccaataccctcgtgcgcttcgccagcaccagatccacaggcgtggaaaacagcggggcaggccccaccagcttcaagaccatgaagatcatcgacccccagcacagcgacaagcccaacgtgctgatcctgggctctggctggggcgccatctcgtttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaagccaccagcatcaaccccgaccggaacaccgtgaccatcaagagcctgagcgccgtgtcccagctgtaccagcccgagaaccacctgggcctgcaccaggccgagcccgccgagattaagtacgactatctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtcgtcgtgggtggagggcccactggcgtggaagctgctggcgagctgcaggactacgtgcaccaggacctgcggaagtttctgcccgccctggccgaggaagtgcagattcacctggtggaagccctgcccatcgtgctgaacatgttcgagaagaagctgagcagctacgcccaaagccacctggaaaacacctccatcaaggtgcatctgagaaccgccgtggccaaggttgaagagaagcagttgctggccaagaccaagcacgaggacggcaagataaccgaggaaaccattccctacggcaccctgatttgggccaccggcaacaaggcaagacccgtgatcaccgacctgttcaagaaaatccccgagcagaacagcagcaagcggggcctggcagtgaacgacttcctgcaggtcaaaggcagcaacaacatcttcgccattggcgacaatgcatttgccggcctgcctcctacagcccaggtggcccaccaggaagccgaatacctggccaagaacttcgacaaaatggcccagatccccaatttccagaagaacctgtcctcccggaaggataagatcgacctgctgttcgaggaaaacaacttcaagcccttcaagtacaacgacttaggcgccctggcctacctgggaagcgaaagagccattgccaccatcagaagcggcaagcggaccttctacaccggtggaggcctgatgaccttctacctgtggcggatcctgtacctgagcatgatcctgagcgcccgcagcagactgaaggtgttcttcgactggatcaagctggcattcttcaagagggacttcttcaagggcctgtga

SEQ ID NO: 967 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccctaccagcttcaagaccatgaagatcatcgacccccagcacagcgacaagcccaacgtgctgatcctgggttctggctggggcgctatcagctttctgaagcacatcgacaccaagaagtacaacgtcagcatcatcagccccagaagctacttcttatacacccccctgctgccctctgcccctgtgggaaccgtggacgagaagtccatcatcgagcccatcgtgaacttcgctctgaagaaaaagggcaacgtcacctactatgaggcagaagccaccagcatcaaccccgaccggaacaccgtgaccatcaagagcctgagcgccgtgtcccagctgtaccagcccgaaaaccacctgggcctgcaccaggccgagcccgccgagattaagtacgactacctgatcagcgccgtgggcgccgagcccaacacatttggaatccccggcgtcaccgactacggccacttcctgaaagagatccccaactctctggaaatccggcggaccttcgccgccaacctggaaaaggccaacctgctgcctaagggcgatcccgagcggagaaggctgctgagcattgtggtcgtgggcggaggccccacaggcgtggaagctgctggcgagctgcaggactatgtgcaccaggacctgcggaagtttctccccgccttggccgaggaagtgcagattcacctggtggaagctctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggtaccctgatttgggccaccggcaacaaggccagacccgtgatcaccgacctgttcaagaagatccccgagcagaacagcagcaagagaggcctggccgtgaacgacttcctgcaggtcaaaggcagcaacaacatcttcgccatcggcgacaacgcctttgccggcctgcctccaacagcccaggtggcccaccaagaagccgagtacctggccaagaacttcgacaaaatggcccagatccccaatttccagaagaacctgtcctcccggaaggataagatcgacctgctgttcgaggaaaacaacttcaagcctttcaagtacaacgacctgggcgccctggcctacctgggcagcgaaagagccattgccaccatcagatccggcaagcggaccttctacaccggcggaggcctgatgaccttctacctgtggcggattctgtacctgagcatgatcctgagcgcccgcagcagactgaaggtgttcttcgactggatcaagctggccttcttcaagagggacttcttcaagggattatga

SEQ ID NO: 968 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctagtgcgcttcgccagcaccagatccaccggcgtcgaaaacagcggggctggccccaccagcttcaagaccatgaagatcatcgacccccagcacagcgacaagccaaacgtgctgatcctgggctctggctggggcgccatcagctttctgaagcacatcgacaccaagaagtacaacgtcagcatcgtgtctcccagaagctacttcctgttcacccccctgctgcccagcgcccctgtgggaaccgtggacgagaagtccatcatcgagcccatcgtgaacttcgccctgaagaaaaagggcaacgtcacctactacgaggccgaggccacctctatcaaccccgaccggaacaccgtgaccatcaagagcctgagcgccgtgtcccagctgtaccagcccgaaaaccacctgggcctgcatcaagccgagcctgccgagattaagtacgactacctgatcagcgccgtgggtgccgagcccaacacctttggaatccccggcgtgaccgactacggccacttcctgaaagaaatccccaactctctggaaatccggcggaccttcgccgccaacctggaaaaggctaacctgttgcctaagggcgaccccgagcggagaaggctgctgagcatcgtggtggtgggcggaggccccacaggcgtggaggctgctggcgagctgcaggactacgtgcaccaggacctgcggaagttcctgcccgccctggccgaggaagtgcagattcacctggtggaagctctgcccatcgtgctgaacatgttcgagaagaagctgagctcatacgcccagagccacctggaaaacacctccatcaaggtgcacctgagaaccgccgtcgccaaggtggaagagaagcagctgctggccaagaccaagcacgaggacggcaagattaccgaggaaaccatcccctacggcaccctgatttgggccacgggtaacaaggccagacccgtgatcaccgacctgttcaagaagatccccgagcaaaacagcagcaagcggggcctggccgtgaatgacttcttgcaggtcaaaggcagcaacaacatcttcgccatcggcgacaacgcctttgctggcctgcctcctacagcccaggtggcccaccaggaagccgagtacctggccaagaacttcgacaagatggcccagatccccaatttccagaagaacctgtcctcacggaaggataagatcgacctgctgttcgaggaaaacaacttcaagcccttcaagtacaacgatctgggcgccctggcctacctgggcagcgaaagggccattgccaccatcagaagcggcaagcggaccttctacaccggtggaggcctgatgaccttctacctgtggcggatcctgtacttgagcatgatcctgagcgcccgcagcagactgaaggtgttcttcgactggatcaagctggccttcttcaagagggacttcttcaagggcctgtag

SEQ ID NO: 969 - DNA, 1542 bp, Artificial Sequence
  source: /note="Description of Artificial Sequence: Synthetic polynucleotide"
atgctgagcaagaatctgtacagcaacaagcggctgctgaccagcaccaacaccctcgtgcgcttcgccagcaccagatccaccggcgtcgaaaacagcggggctggccccacaagcttcaagaccatgaaagtcatcgacccccagcacagcgacaagcccaacgtgctgatcctgggctctggctggggcgccatcagctttctgaagcacatcgacaccaagaagtacaacgtcagcatcatcagccccagaagctacttcatcttcacccccttgttacccagcgcccctgtgggaaccgtggacgagaagtccattatcgagcccatcgtgaacttcgccctcaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgaaattaagtacgactacctgatcagcgccgtgggcgccgagcccaacacctttggaatccccggggtgaccgactacggtcacttcctgaaagaaatccccaacagcctggaaatccggcggactttcgccgccaacctagaaaaggccaacctgctgcctaagggcgaccccgagcggagaaggctgctgagcatcgtggtcgtgggcggaggccccacaggcgtggaagctgctggcgagctacaggattacgtgcaccaggacctgcggaagttcctgcctgccctggccgaggaagtccagattcacctggtggaagccctgcccatcgttctgaacatgtttgagaagaagctgagcagctacgcccagtcacacctggaaaacacttccatcaaggtgcacctgagaaccgctgtggccaaggtggaagagaagcagttgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctaccgcccaggtggcccaccaagaggccgagtacctggccaagaacttcgacaagatggcccagatccccaatttccagaagaacctgtcctcccggaaggataagatcgacctgttgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctaagcgcccgcagcagactgaaggtgttcttcgactggatcaaactggccttcttcaagagggactttttcaagggcctgtga

SEQ ID NO: 970 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccacctctttcaagaccatgaaggtcattgacccccagcacagcgacaagcccaacgtgctgatcctgggctctggctggggcgccatcagctttctgaagcacatcgacaccaagaagtacaacgtcagcatcatcagccccagaagctatttcatcttcacccccctgctgcctagcgcccctgtgggaaccgtggacgagaagtccatcatcgagcccatcgtgaacttcgccctgaagaaaaagggcaacgtcacctactacgaggcagaggccaccagcatcaaccccgaccggaacaccgtgaccatcaagagcctgagcgccgtttcccagctgtaccagcccgagaaccacctgggcctgcaccaggccgagcccgccgagattaagtacgactacctgatcagcgccgtgggcgccgagcccaacacctttggaatccccggcgtgaccgactacggtcacttcctgaaagagatccccaacagcctggaaatcagacggaccttcgccgccaacctggaaaaggccaacctgctgccaaagggcgaccccgagagaagaaggctgctgagcatcgtggtcgtgggcggaggccccacaggcgtggaggctgctggcgagctacaggactacgtgcaccaggacctgcggaagttcctgcccgccctggccgaggaaatccagattcacctggtggaagccctgcccatcgtgctgaacatgttcgagaagaagctgtcaagctacgcccagagccacctggaaaacacttcgatcaaggtacacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagctccaagcggggcctggccgtgaacgacttcctgcaggtcaaaggcagcaacaacatcttcgccatcggcgacaacgcctttgccggcctgccacctacagcccaggtggcgcaccaggaggccgaatacttggccaagaacttcgacaagatggcccagatccccaatttccagaagaacctgtcctcacggaaggataagatcgacctgctgttcgaggaaaacaacttcaagcccttcaagtacaacgacctgggcgccttagcctacctgggcagcgaaagagccattgccaccatacgtagcggtaagcggaccttctacaccggcggaggcctgatgaccttctacctgtggcggatcctgtacctgagcatgatcctgagcgcaagaagcagactgaaggtgttcttcgactggatcaagctggccttcttcaagagggacttcttcaaaggcctgtga

SEQ ID NO: 971 - DNA, 1542 bp, Artificial Sequence
  source: /note="Description of Artificial Sequence: Synthetic polynucleotide"
atgctgagcaagaacctgtacagcaacaagcggctgctgacctcgaccaacaccctcgtgcgcttcgccagcaccagatccaccggcgtcgaaaacagcggggctggccccaccagctttaagaccatgaaaatcattgacccccagcacagcgacaagcccaacgtgctgatcctgggctctggctggggcgccatcagctttctgaagcacatcgacaccaagaagtacaacgtcagcatcatcagccccagaagctacttcctgttcacccccctgttacccagcgcccctgtgggaaccgtggacgagaagtccatcatcgagcccatcgtgaatttcgccctgaagaaaaagggcaacgtcacctactacgaggccgaggccaccagcatcaaccccgaccggaacaccgtgaccataaagagcctgagcgccgtgtcccagctgtaccagcccgagaaccacctgggcctgcaccaggccgagcccgccgagattaagtacgattacctgatcagcgccgtaggcgccgagcccaacacctttggaatccctggcgtgaccgactacggccacttcctgaaagagatccccaacagcctggaaatccggcggaccttcgccgccaacctggaaaaggccaacctgctgcctaagggcgaccccgaacggagaaggctgctgagcatcgtggtcgtgggcggaggccctactggcgtggaagctgctggcgagctacaggactacgtgcaccaggacctgcggaagttcctgcccgccctggccgaggaaatccagattcacttggtggaagccctgcccatcgtgctgaacatgttcgagaagaagcttagcagctacgcccagagccacctggaaaacacctccatcaaggtgcacctgagaaccgccgtggccaaggtggaagaaaagcagctgctggccaagaccaagcacgaggacggcaagattaccgaggaaaccatcccctacggcactctgatttgggccaccggcaacaaggcaagacccgtgatcaccgaccttttcaagaagatccccgagcagaacagcagcaagcggggcttggccgtgaacgacttcctgcaggtcaaaggcagcaacaacatcttcgccatcggcgacaatgcctttgccggcctgcctcctaccgcccaggtggcccaccaagaagccgaatacctggccaagaacttcgacaaaatggcccagatccccaatttccagaagaacctgtcctcccggaaggataagatcgacctgctgttcgaggaaaacaactttaagcccttcaagtacaacgacctgggcgccctggcctacctgggcagcgaaagagccattgccaccatcagaagcggcaagagaaccttctacaccggcggaggcctgatgaccttctacctgtggcggatcctgtacctgagcatgatcctgagcgcccgctcgagactgaaggtgttcttcgactggatcaagctggccttcttcaagagggacttctttaagggcctgtga

SEQ ID NO: 972 - DNA, 1542 bp, Artificial Sequence
  source: /note="Description of Artificial Sequence: Synthetic polynucleotide"
atgctgagcaagaacctgtacagcaacaagcggctgctcaccagcaccaacaccctcgtgcgcttcgccagcaccagatccaccggcgtcgaaaacagcggagctggtcccaccagcttcaagaccatgaaaatcatcgacccccagcacagcgacaaacccaacgtgctgatcctgggctctggctggggagccatcagctttctgaagcacatcgacaccaagaagtacaacgtcagcatcatcagccccagaagctacttcatcttcacccccctgctgcccagcgcccctgtgggaaccgtggacgagaagtccatcattgagcccatcgttaacttcgccctgaagaaaaagggcaacgtcacctactacgaggcagaggccaccagcatcaaccccgaccggaacaccgttaccatcaagagcctgtctgccgtgtcccagctgtaccagcccgagaaccacctgggcctgcaccaggccgagcccgccgagattaagtacgactacttaatcagcgccgtgggcgccgagcccaacacctttggaatccccggcgtcaccgactacggccacttcctgaaagagatccccaacagcctggaaatccggcggaccttcgccgccaacctggaaaaggccaacctgctgcctaagggcgaccccgagcggagaaggctgctgtccatcgtggtcgtgggcggaggccctacaggcgtggaagctgctggcgagctgcaggactacgtgcaccaggacctgcggaagttcctgcccgccctggccgaggaagtgcagattcacctggtcgaagccctgcccatcgtgctgaacatgttcgagaagaagcttagcagctacgcccaaagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggcaagacccgtgatcaccgacctgttcaagaagatccctgagcagaacagcagcaagcggggcctggccgtgaacgacttcctgcaggtcaaaggcagcaacaacatcttcgccatcggcgacaacgcctttgctggcctgcctccaacagcccaggtggcccaccaggaagccgaatacttggccaagaatttcgacaagatggcccagatccccaatttccagaagaacctgtcctcccggaaggataagatcgacctcctgttcgaggaaaacaacttcaagcccttcaagtacaacgacctgggcgccctggcctacctgggcagcgaaagagccattgccaccatcagaagcggcaagcggacattctacaccggcggtggcctgatgaccttctacctgtggcggatcctgtacctgagcatgatcctgagcgcccgcagcagactgaaggtgttcttcgactggatcaagctggccttcttcaagagggactttttcaagggcctgtga

SEQ ID NO: 973 - DNA, 1542 bp, Artificial Sequence
  source: /note="Description of Artificial Sequence: Synthetic polynucleotide"
atgctgagcaagaacctgtacagcaacaagcggctgctgacctcgaccaataccctcgtgcgcttcgccagcaccagatccaccggcgtcgaaaacagcggggctggccccaccagcttcaagaccatgaaggtcatcgacccccagcacagcgacaagcccaacgtgctgatcctgggctcggggtggggcgccatcagctttctgaagcacatcgacaccaagaagtacaacgtcagcatcgtgagccctagaagctacttcctgttcacccctctgctgcccagcgcccctgttgggaccgtagacgagaagtcaatcatcgagcccatcgtgaacttcgccctgaagaaaaagggcaacgtcacctactacgaggccgaggccaccagcatcaaccccgaccggaataccgtgaccatcaagagcctgagcgccgtgtcccagctgtaccagcccgagaaccacctgggcctgcaccaggccgagcccgccgagattaagtacgattacctgatcagcgccgtgggcgccgagcccaacacctttggaatccccggcgtgaccgactacggccacttcctgaaagagatccccaacagcctggaaatccggcggaccttcgccgccaacctggaaaaggccaacctgttgcctaagggcgaccccgagcggagaaggctgctgagcatcgtggtcgtgggcggaggccccacaggtgtggaagctgctggcgagctgcaggattacgtgcaccaggacctgcggaagttcctgcccgccctggccgaggaagtgcagattcacctggtggaagccctgcccatcgtgctgaacatgttcgagaaaaagctgagcagctacgcccaaagccacctggaaaacacctccatcaaagtacacctgagaaccgccgtggccaaggtggaagaaaagcagttgttggccaagaccaagcacgaggacggcaagattaccgaggaaaccatcccctacggcaccctgatttgggccaccggcaacaaggccagacccgtgatcacagacctgttcaagaagatccccgagcagaacagcagcaagcggggcctggccgtgaacgacttcctgcaggtcaaaggcagcaacaacatcttcgccatcggcgacaacgcctttgccggcctgcctcctaccgcccaggtggcccaccaggaagccgagtacctggccaagaacttcgacaaaatggcccagatccccaatttccagaagaacctgtcctccagaaaggataagattgacctgctgttcgaggaaaacaacttcaagcccttcaagtacaacgacctgggtgccctggcctacctgggcagcgaaagagccattgccaccatcagaagcggcaagcggaccttttacaccggcggaggcctgatgaccttctacctgtggcggatcctgtacatgagcatgatcctgagcgcccgcagcagactgaaggtgttcttcgactggatcaagctggccttcttcaaaagggacttcttcaagggcctgtga

SEQ ID NO: 974 - DNA, 1542 bp, Artificial Sequence
  source: /note="Description of Artificial Sequence: Synthetic polynucleotide"
atgctaagcaagaacctgtatagtaacaagcggctgctgaccagcaccaacaccctcgtgcgcttcgccagcaccagatccaccggcgtcgaaaacagcggggctggccctaccagcttcaagaccatgaagatcatcgacccccagcacagcgacaagcccaacgtgctgatcctgggctctggctggggcgccatcagctttctgaagcacattgacaccaagaagtacaacgtcagcatcatcagccccagaagctacttcatcttcacccccctgctgccctctgcccctgtgggaaccgtggacgagaagtccatcattgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccccggggtgaccgactacggccacttcctgaaagagatccccaacagcctggaaatccggcggaccttcgccgccaacctggaaaaggccaacctgttgcctaagggcgaccccgagcggagaaggctgctgtccatcgtggtcgtgggcggagggcccacaggcgtagaagctgctggcgagctgcaggactacgtgcaccaggacctgcggaagttcctgcccgccctggccgaggaagtccagattcacctggtggaagccctgcccatcgtgctgaacatgttcgagaagaagctgagcagctacgcccagagccacctggaaaacacctccatcaaggtgcacctgagaaccgccgtggccaaagtggaagagaagcagctgctggccaagaccaaacacgaggacggcaagataaccgaggaaaccattccctacggcaccctgatttgggccaccggcaacaaggccagacccgtgatcaccgacctgttcaagaagatccccgagcaaaacagcagcaagcggggcctggccgtgaacgacttcctgcaagtcaaaggcagcaacaacattttcgccatcggcgacaacgcctttgccggcctgcctccaacagcccaggtggcccaccaggaagccgaatacctggccaagaacttcgacaagatggcccagatccccaatttccagaagaacctgtcctccagaaaggataagatcgacctgctgttcgaggaaaacaacttcaagcccttcaagtacaacgacctgggcgccctggcctacctgggaagcgaaagagccattgccaccatcagaagcggcaagcggaccttctacaccggcggaggcttaatgaccttctacctgtggcggatcctgtacctgagcatgatcctaagcgcccgcagcagactgaaggtcttcttcgactggattaagctggcctttttcaagagggacttcttcaagggcctgtag

SEQ ID NO: 975 - DNA, 1542 bp, Artificial Sequence
  source: /note="Description of Artificial Sequence: Synthetic polynucleotide"
atgctgtcgaagaacctgtacagcaacaagcggttgctgaccagcaccaacaccctcgtgcgcttcgccagcaccagatccaccggcgtcgaaaacagcggggctggccccaccagctttaagaccatgaaggtcatcgacccccagcacagcgacaagcccaacgtgctgatcctgggctctggctggggcgccatcagctttctgaagcacatcgacaccaagaagtacaacgtcagcatcatcagccctagaagctacttcatctacacccccctgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaataccgtgaccatcaagagcttaagcgccgtttcccagctgtaccagcccgagaaccacctgggcctgcatcaggccgagcccgccgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtggtcgtgggcggtggccccactggcgtggaagctgctggcgagctgcaggactacgtgcaccaggacctgcggaagtttctccccgcactggccgaagaaatccagattcacctggtggaagccctgcccatcgtgctgaacatgttcgagaagaagctgagcagctacgcccagagccacctggaaaacacctccatcaaggtgcacctgagaacggccgtggccaaggtggaagagaagcagttgctggcaaagaccaagcacgaggacggcaagattaccgaggaaaccatcccctacggtaccctgatttgggccaccggcaacaaggccagacccgtgatcaccgacctgttcaagaagatccccgagcagaactcgagcaagcggggcttggccgtgaacgacttcctgcaggtcaaaggcagcaacaacattttcgccatcggcgacaatgcctttgccggcttgcctcctacagcccaggtggcccaccaggaagccgagtacctggccaagaacttcgacaagatggcccagatccccaatttccagaagaacctgtcctcccggaaggataagatcgatctgttgttcgaggaaaacaacttcaagcccttcaagtacaacgacctgggcgccttagcctacctgggcagcgaaagagccattgccaccatcagaagcggcaagagaaccttctacaccggcggaggcctgatgaccttctacctgtggcggatcctgtacctgagcatgatcctaagcgccagaagcagactgaaggtgttcttcgactggatcaagctggcattcttcaagagggacttcttcaagggcctgtga

SEQ ID NO: 976 - DNA, 1542 bp, Artificial Sequence
  source: /note="Description of Artificial Sequence: Synthetic polynucleotide"
atgctgagcaagaacctgtacagcaacaagcggttgctcaccagcaccaacaccctcgtgcgcttcgccagcaccagatccaccggcgtggaaaacagcggggctggccccaccagctttaagaccatgaagatcatcgacccccagcacagcgacaaacccaacgtgctgatcctgggctctggctggggcgccatcagctttctgaagcacatcgacaccaagaagtacaacgtcagcatcatcagccccagaagctacttcatcttcacccccctgttacccagcgcccctgtgggaaccgtggacgagaagtccatcatcgagcccatcgtgaacttcgccctgaagaaaaaggggaacgtcacctactatgaggccgaggccaccagcatcaaccccgaccggaacaccgtgaccatcaaaagcctgagcgccgtgtcccagctgtaccagcccgagaaccacctgggcctgcaccaggccgagcccgccgagattaagtacgactacctgatcagcgccgtgggcgccgagcccaacacctttggaattcccggcgtgaccgactacggccacttcctgaaagagatccccaacagcctggaaatcagacggaccttcgccgccaacctggaaaaggccaacctgctgcctaagggcgaccccgagcggagaaggctactgagcatcgtggtcgtgggcggaggccccacaggcgtggaagctgctggcgagctgcaggattacgttcaccaggacctgcggaagttcctgcccgccttggccgaggaaatccagattcacctggtggaagccctgcccatcgtgctgaacatgttcgagaagaagcttagcagctacgcccagagccacctggaaaacacctccatcaaggtgcacctgagaaccgccgtggccaaggtggaagagaagcagctgctggccaagaccaaacacgaggacggcaagattaccgaggaaaccatcccctacggcaccctgatttgggccaccggcaacaaggccagaccggtgatcaccgacctgttcaagaagatccccgagcagaacagcagcaagcggggcctggccgtgaacgacttcttgcaggtcaaaggcagcaacaacatcttcgccatcggcgacaacgcctttgctggcctgcctcctacagcccaggtggcccaccaggaagccgagtacctggccaagaacttcgacaagatggcccagatacccaatttccaaaagaacctgtcctcccggaaggataagatcgacctgctgttcgaggaaaacaacttcaagcccttcaagtacaacgacctgggcgccctggcatacctgggcagcgaaagagccattgcaaccatcagaagcggcaagcggaccttttacaccggcggtggcctgatgaccttctacctgtggcggatcctgtacctgagcatgattctgagcgcccgctcgagactgaaggtgttcttcgactggatcaagctggccttcttcaagagagacttctttaagggcctgtga

SEQ ID NO: 977 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaactccggggctggccccaccagcttcaagaccatgaagatcatcgacccccagcacagcgacaagcccaacgtgctgatcctgggctctggctggggcgctattagctttctgaagcacatcgacaccaagaagtacaacgtcagcatcgtgagccccagaagctatttcctgttcacccccctgctgccctctgcacctgtgggaaccgtggacgagaagtccattatcgagcccatcgtgaacttcgccctgaagaaaaagggcaacgtcacctactacgaggccgaggccaccagcatcaaccccgaccggaacaccgtgaccatcaagagcctgagcgccgtttcccagctgtaccagcccgagaaccacctgggcctgcaccaggccgagcccgccgagattaagtacgactacctgatcagcgccgtgggcgccgagcccaacacctttggtatccccggcgtgaccgactacggtcacttcctgaaagagatccccaacagcctggaaatccggcggaccttcgccgccaacctggaaaaggccaacctgttgcctaagggcgaccccgagcggagaaggctactgagcatcgtggtcgtgggcggaggccccacaggcgtggaagctgctggcgagctgcaggattatgttcaccaggacctgcggaagttcctccccgccctggccgaggaagtccagattcacctggtggaagccctgcccatcgtgctgaacatgttcgagaagaagctgtcaagctacgcccagagccacctggaaaacacctccatcaaggtgcacctgagaaccgccgtggccaaggtggaagagaagcagctgctggccaagacgaagcacgaggacggcaagattaccgaggaaaccatcccctacggcaccttgatttgggccaccggcaacaaggccagacccgtgatcaccgacctgttcaagaagatccccgagcagaacagcagcaagagaggactggccgtgaacgacttcttgcaggtcaaaggcagcaacaacatcttcgccatcggcgacaacgcctttgccggcctgcctcctacagcccaggtggcgcaccaggaagccgaatatctggccaagaacttcgacaagatggcccagatccccaatttccagaagaacctgtcctcccggaaggataagatcgacctgctgttcgaggaaaacaacttcaagcccttcaagtacaacgacttaggcgccctggcctacctgggaagcgaaagagccattgccaccatccgtagcggcaagcggaccttctacaccggcggaggcttaatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 978 - DNA, 1542 bp, Artificial Sequence
  source: /note="Description of Artificial Sequence: Synthetic polynucleotide"
atgctgagcaagaatctgtacagcaacaagcggctgctgaccagcaccaacaccctagtccgcttcgccagcaccagatccaccggcgtcgaaaacagcggggctggtcccaccagcttcaagaccatgaaggtcatcgacccccagcacagcgacaaacccaacgtgctgatcctgggctctggctggggcgccatcagctttctgaagcacatcgacaccaagaagtacaacgtcagcatcatcagccccagaagctacttcctgtacacccccctgctgcccagcgcccctgttggaaccgtggacgagaagtccatcatcgagcccatcgtgaacttcgccctgaagaaaaaggggaacgtcacctactacgaggccgaggccaccagcatcaaccccgaccggaacaccgtgaccatcaaaagcctgagcgccgtgtcccagctataccagcccgagaaccacctgggcctgcaccaagcagagcccgccgagattaagtacgactatctgatcagcgccgtgggcgccgagcccaacacctttggaattcccggcgtgaccgactacggccacttcctgaaagagatccccaacagcttggaaatacggcggaccttcgccgccaacctggagaaggccaacctgctgcctaagggcgaccccgagcggagaaggctgctgagcatcgtggtcgtgggcggaggccccacaggcgtggaagctgctggcgagctgcaggactacgtgcaccaggacctgcggaagtttctgcccgccctggccgaagaaatccagattcacctggtggaagccctgcccatcgtgctgaacatgttcgagaagaagctgagcagctacgcccagagccacctggaaaacacctccatcaaggtgcatctgagaaccgccgtggccaaggtggaagagaagcagctgctggccaagaccaagcacgaggacggcaagattaccgaggaaaccattccctacggcaccctgatttgggccaccggtaacaaggcaagacccgtgatcaccgacctgttcaagaagatccccgagcagaacagctccaagcggggcctggccgtgaacgacttcctgcaggtcaaaggcagcaacaacattttcgccatcggcgacaatgcctttgccggcctgcctcctacagcccaggtggcccaccaggaggccgagtacctggccaagaactttgacaagatggctcagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgagcatgatcctgagcgcccgcagcagactgaaggtgttcttcgactggatcaagctggcattcttcaaaagggacttcttcaagggcctgtga

SEQ ID NO: 979 - DNA, 1542 bp, Artificial Sequence
  source: /note="Description of Artificial Sequence: Synthetic polynucleotide"
atgctgagcaagaacctgtacagcaacaagaggctgctgaccagcaccaacaccctagtgcgcttcgccagcaccagatccaccggcgtcgaaaacagcggagctggccccaccagcttcaagaccatgaaggtcatcgacccccagcacagcgacaagcccaacgtgctgatcctgggttctggctggggcgccatcagctttctgaagcacatcgacaccaagaagtacaacgtcagcatcatcagccccagaagctacttcctgtacacccccctgctgccttctgccccagtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcctgagaaccacctgggcctgcaccaggccgagcccgccgagattaagtacgattatctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtcgtcgtgggcggaggccccacaggtgtggaagctgctggcgagctgcaggactacgtgcaccaggacctgcggaagttcctgcccgccctggccgaggaaatccagattcacctggtggaagctctgcccatcgttttgaacatgttcgagaagaagctgagcagctacgcccagagccacctggaaaacacctccatcaaggtgcacctgagaaccgccgtggccaaggtggaagagaagcagctgctggcaaagaccaagcacgaggacggcaagattaccgaggaaactatcccctacggcaccctgatttgggccaccggcaacaaggccagacccgtaatcaccgacctgttcaagaagatccccgagcagaacagcagcaagcggggcctggccgtgaacgacttcctgcaggtcaaaggcagcaacaacatcttcgccattggcgacaacgcctttgccggcttgcctcctacagcccaggtggcccaccaggaagccgagtacttggccaagaacttcgataagatggcccagatcccaaatttccagaagaacctgtcctcccggaaggataagatcgacctgctgttcgaggaaaacaactttaagcccttcaagtacaacgacctgggcgccctggcctacctgggctccgaaagagccattgccaccatcagaagcggtaagcggaccttctacaccggcggaggcctgatgaccttctacctgtggcggatcttgtacatgagcatgattctgagcgcccgcagcagactgaaggtgttcttcgactggatcaagctggcctttttcaagagggacttcttcaagggcctgtga

SEQ ID NO: 980 - DNA, 1542 bp, Artificial Sequence
  source: /note="Description of Artificial Sequence: Synthetic polynucleotide"
atgctgagcaagaacctgtacagcaacaagcggttgctgaccagcaccaacaccctcgtgcgcttcgccagcaccagatccaccggcgtcgaaaacagcggggctggccccaccagcttcaagaccatgaaagtcatcgacccccagcacagcgacaagccaaacgtgctgatactgggctctggctggggcgccatcagctttctgaagcacatcgacaccaagaagtacaacgttagcatcatcagccccagaagctacttcctgtacacccccttgctgcccagcgcccctgttggaaccgtggacgagaagtccatcatcgagcccatcgttaacttcgccctgaagaaaaagggcaacgtcacctactacgaggccgaggccaccagcatcaaccccgaccggaacaccgtgaccataaagagcctgagcgccgtgtcccagctgtaccagcccgagaaccacctggggctgcaccaagccgagcccgccgagattaagtacgactacctgatcagcgccgtgggcgccgagcctaacacctttggaatccccggcgtgaccgactacggccacttcctgaaagagatccccaacagcctggaaatccggcggaccttcgccgccaacctagaaaaggccaacctgctgcctaagggcgaccccgagcggagaaggctgctgagcatcgtggtcgtgggcggaggccccacaggcgtggaagctgctggcgagctgcaggactatgtgcaccaggacctgcggaagttcctgcccgccctggccgaggaagtgcaaattcacctggtggaagccctgcccatcgtgctgaacatgttcgagaagaagctgagcagctacgcccagagccatctggaaaacacctccatcaaggtgcacctgagaaccgccgtggccaaggtggaagagaagcaactgctggccaagaccaagcacgaagacggcaagattaccgaggaaaccatcccctacggcaccctgatttgggccacgggcaacaaggccagacccgtgatcaccgaccttttcaagaagatccccgagcagaacagctccaagcggggactggccgtgaacgacttcctgcaggtcaaaggcagcaacaacatcttcgccatcggcgacaacgcctttgccggcctgcctcctacagcccaggtggcccaccaggaagccgagtacctggccaagaattttgacaagatggcccagatccccaatttccagaagaacctgtcctcccggaaggataagatcgacctgctgttcgaggagaacaacttcaagcccttcaagtacaacgacctgggcgccttagcctacctgggcagcgaaagagccattgccaccatcagaagcggcaagcggaccttctacaccggcggtggcctgatgaccttctacttatggcggatcatctacatgagcatgattctgagcgcccgcagcagactgaaggtgtttttcgactggatcaagctggccttcttcaagagggacttcttcaagggcctgtga

SEQ ID NO: 981 - DNA, 1542 bp, Artificial Sequence
  source: /note="Description of Artificial Sequence: Synthetic polynucleotide"
atgctgagcaagaacctgtacagcaacaagaggctgctgaccagcaccaacaccctcgtgcgcttcgccagcaccagatccaccggcgtcgaaaacagcggggctggccccaccagctttaagaccatgaaggtcatcgacccccagcacagcgacaagcccaacgtgctgatcctgggctctggctggggcgccatcagctttctgaagcacatcgacaccaagaagtacaacgtcagcatcatcagccccagaagctacttcctgtacacccccctgctgcccagcgcccctgtgggaaccgtggacgagaagtccattatcgagcccatcgtgaacttcgccctgaagaaaaagggcaacgtcacctactacgaggcagaggccaccagcatcaaccccgaccggaataccgtgaccatcaagtcactgagcgccgtgtcccagctgtaccagcccgagaaccacctgggcctgcaccaggccgagcccgccgagattaagtacgactacctgatcagcgccgtaggcgccgagcccaacacctttggaatccccggcgtcaccgactacggccacttcctgaaagagatccccaacagcttggaaatccggcggaccttcgccgccaacctggaaaaggccaacttattgcctaagggcgaccccgagcggagaaggctgctgagcatcgtggtcgtgggcggaggccctacaggcgtggaagccgctggcgagctgcaggactacgtgcaccaggacctgcggaagttcctgcccgccttggccgaggaagtgcagattcacttggtggaagccctgcccatcgtgctgaacatgttcgagaagaagctgagcagctacgcccagagccacctggaaaacacctccatcaaggtgcacctgagaaccgccgtggccaaggtggaagaaaagcagctgctggccaagaccaagcacgaggacggcaagattaccgaagaaaccatcccctacggcaccctgatttgggccacgggcaacaaggccagaccggtgatcaccgacctgttcaagaagatccccgagcagaacagctccaagcggggactggccgtgaacgacttcctgcaggtcaaaggcagcaacaacatcttcgccatcggcgacaacgcctttgccggcctgcctcctacagcccaggtggcccaccaagaagccgaatatctggccaagaacttcgacaaaatggcccaaatccccaatttccagaagaacctgtcctcacggaaggataagatcgacctgctgttcgaggaaaacaacttcaagcccttcaagtacaacgacttaggcgccctggcctacctgggcagcgaaagagccattgccaccatcagaagcggcaagcggacattctacaccggtggaggcctgatgaccttctacctgtggcggatcatctacatgagcatgatcctgagcgcccgcagcagactgaaggtgttcttcgactggatcaagctggccttcttcaagagggacttcttcaagggcctgtga

SEQ ID NO: 982 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgcctccaccagatccaccggcgtcgaaaacagcggggctggccctaccagcttcaagaccatgaagatcattgacccccagcacagcgacaagcccaacgtgctgatcctgggctctggctggggcgccattagctttctgaagcacatcgacaccaagaagtacaacgtcagcatcatcagccccagaagctacttcctgttcacccccctgctgcccagcgcccctgtgggaacagtggacgagaagtccatcatcgagcccatcgtgaatttcgccctgaagaaaaagggcaacgtcacctactacgaggccgaggccaccagcatcaatcccgaccggaacaccgtgaccatcaagagcttaagcgccgtgtcccagctgtaccagcccgagaaccacctagggctgcaccaggccgagcccgccgagattaagtacgactacctgatcagcgccgtgggcgccgagcccaacacctttggaatccccggcgtgaccgactacggccacttcctgaaagagatccccaacagcttggaaatccggcggaccttcgccgccaacctggaaaaggctaacctgctgcctaagggcgaccccgagcggagaaggctgctgagcatcgtggtcgtgggcggtggccccacaggcgtggaagccgctggcgagctgcaggactacgttcaccaggacctgcggaagttcctgcccgccttggccgaggaaatccagattcacctggtggaagccctgcccatcgtgctgaacatgttcgagaagaagctgagcagctacgcccagagccacctggaaaacacctccatcaaggtgcacctgagaaccgctgtggccaaggtggaagaaaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccgggctgcctcctacagcccaggtggcccaccaagaagccgagtacctggccaagaacttcgacaagatggcccagatccccaatttccagaagaacctgtcctcacggaaggataagattgacctgctgttcgaggaaaacaactttaagcccttcaaatacaacgacctgggcgccctggcctacctgggcagcgaaagagccattgcaaccatcagaagcggcaagcggacattctacaccggcggaggcctgatgaccttctacctgtggcggatcttgtacatgagcatgatcctgagcgcccgctcgagactgaaggtgtttttcgactggatcaagttagccttcttcaagagggacttcttcaagggcctgtga

SEQ ID NO: 983 - DNA, 1542 bp, Artificial Sequence
  source: /note="Description of Artificial Sequence: Synthetic polynucleotide"
atgctgagcaagaacctgtatagtaacaagaggctgctcaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctctggctggggcgctatcagctttctgaagcacatcgacaccaagaagtacaacgtcagcatcatctctcccagaagctacttcctgttcacgcccctgctgcccagcgcacctgtgggaaccgtggacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccagcctgagaaccacctgggcctgcaccaggcagagcccgccgagattaagtacgactacctgatcagcgccgtgggcgccgagcccaacacctttggaatccccggcgtgaccgactacggccacttcctgaaagagatccccaacagcctggaaatacggcggaccttcgccgccaacctggaaaaggccaacctgctgcctaagggcgaccccgagcggagaaggctgctgagcatcgtggtcgtgggcggaggccccactggcgtggaagctgctggcgagctgcaggactacgtgcaccaggacctgcggaagttcctgcctgccctggccgaggaaatccagattcacctggtggaagccctgcccatcgtgctgaacatgttcgagaagaagctgagctcatacgcccagagccacctggaaaacacctccatcaaggtgcacctgagaaccgccgtggccaaggtggaagaaaagcagctgctggccaagaccaagcacgaggacggcaagattaccgaggaaaccatcccatacggcaccctgatttgggccaccggcaacaaggccagacccgtgatcaccgacctgttcaagaagatccctgagcagaacagcagcaagcggggattggccgtgaacgacttcctgcaggtcaaaggcagcaacaacattttcgccatcggtgacaacgcctttgccgggctgcctcctacagcccaggtggcccaccaggaagccgagtacctggccaagaacttcgacaagatggcccagatacccaatttccagaagaacctgtcctcccggaaggataagatcgatctgctgttcgaggaaaacaacttcaagcccttcaagtacaacgacctgggcgccttagcctacctgggcagcgaaagagccattgccaccatacgtagcggtaagcggacattctacaccggcggaggcctgatgaccttctacctgtggcggatcatctacatgagcatgatcctgagcgcccgcagcagactgaaggtgttcttcgactggatcaagttagccttcttcaagagggacttcttcaagggcctgtga

SEQ ID NO: 984 - DNA, 1542 bp, Artificial Sequence
  source: /note="Description of Artificial Sequence: Synthetic polynucleotide"
atgctaagcaagaatttgtacagcaacaagcggctgctgaccagcaccaacaccctcgtgcgcttcgccagcaccagatccaccggggtcgaaaacagcggggcaggccccacctctttcaagaccatgaaggtcatcgacccccagcacagcgacaaacccaacgtgctgatcctgggctctggctggggcgccatcagctttctgaagcacatcgacaccaagaagtacaacgtcagcatcatctctcccagaagctacttcctgtacacccctctgctgcccagcgcccctgtgggaaccgtagacgagaagtccattatcgagcccatcgttaacttcgccctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgcggagcccaacacctttggaattcccggcgtgaccgactacggccacttcctgaaagagattcccaacagcctggaaatccggcggaccttcgccgccaacctggaaaaggccaacttactgcctaagggcgatcccgagcggagaagactgctgagcatcgtggtcgtgggcggaggccccacaggcgtggaagctgctggcgagctgcaggactacgtgcaccaggacctgcggaagttcctgcccgccctggccgaagaagtgcagattcacctggtggaagccctgcccatcgtgctgaacatgttcgagaagaagctgagcagctacgcccagagccatctggaaaacacctccatcaaggtgcacctgagaaccgccgtggccaaggtggaagagaagcagctgctggccaagaccaagcacgaggacggcaaaattaccgaggaaaccatcccctacggcaccctgatttgggccaccggcaacaaggcaagacccgtgatcaccgacctgttcaagaagatccccgagcagaacagcagcaagcggggcctggccgtgaacgacttcttgcaggtcaaaggcagcaacaacatcttcgccatcggcgacaatgcctttgccggcctgcctcctacagcccaagtggcccaccaggaagccgagtacctggccaagaatttcgacaaaatggctcagatccccaatttccagaagaacctgtcctcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacttatggcggatcatctacatgagcatgatcctgagcgcccgcagcagactgaaggtgttcttcgactggatcaagctggccttcttcaagagggacttcttcaaaggcctgtga

SEQ ID NO: 985 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggcgtcgaaaacagcggggctggccccaccagctttaagaccatgaaaatcatcgacccccagcacagcgacaagcccaacgtgctgatcctgggctctggctggggagccatcagctttctgaagcacatcgacaccaagaagtacaacgtcagcatcatcagccctagaagctacttcatcttcacccccctgctgcctagcgcccctgtgggaaccgtggacgagaagtcaatcatcgagcccatcgtgaacttcgccctgaagaaaaagggcaacgtcacctactacgaggccgaggccaccagcatcaaccccgaccggaacaccgtgaccataaagtcactgagcgccgtgtcccagctgtaccagcctgagaaccacctagggctgcaccaggccgagcccgccgagattaagtacgactacctgatcagcgctgtgggcgccgagcccaacacctttggaatccccggcgtgaccgactacggccacttcctgaaagaaatccccaacagcctggaaatccggcggactttcgccgccaacctggaaaaggccaacctgctgcctaagggcgaccccgaacggagaaggctgctgtccatcgtcgtcgtgggcggaggccccacaggcgtggaagctgctggcgagctgcaggactacgtgcaccaggacctgcggaagttcctgcccgccctggccgaagaagtgcagattcacctggtggaagccctgcccatcgtgctgaatatgtttgagaagaagctgagcagctacgcccagagccacctggaaaacacctccatcaaggtgcacctgagaaccgccgtggccaaggtggaagaaaagcagctgctggccaagaccaagcacgaggacggtaagattaccgaggaaaccatcccctacggcaccctgatttgggccaccggcaacaaggccagacccgtgatcaccgacctgttcaagaagatccctgagcagaacagcagcaagagaggcctggccgtgaacgacttcctgcaggtcaaaggcagcaacaacattttcgccatcggcgacaacgcctttgccggcctgccacctacagcccaggtggcccaccaggaagccgagtacctggccaagaacttcgacaagatggcccagatccccaatttccagaagaacctatcctcccggaaggataagatcgacctgttgttcgaggaaaacaacttcaagcccttcaagtacaacgacctgggcgccctggcctacctgggcagcgaaagagccattgccaccatccgtagcggcaagcggaccttctacaccggcggaggcctgatgaccttctacctgtggcggatcatctacatgagcatgattctgagcgcccgcagcagactgaaggtgttcttcgactggatcaagctggccttcttcaagagggacttcttcaagggcctgtga

SEQ ID NO: 986 - DNA, 1542 bp, Artificial Sequence
  source: /note="Description of Artificial Sequence: Synthetic polynucleotide"
atgctgagcaagaacttgtacagcaacaagcggttgctgaccagcaccaacaccctcgtgcgcttcgccagcaccagatccacaggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgagccccagaagctacttcctgttcacccccctgctgcccagcgcccctgtgggaaccgtggacgagaagtccatcatcgagcccatcgtgaacttcgccctgaagaaaaagggcaacgtcacctactacgaggccgaagccaccagcatcaaccccgaccggaacaccgtgaccatcaagtcactgagcgccgtgtcccagctgtaccagcccgagaaccacctgggcctgcaccaggccgagcccgccgagattaagtacgactacctgatcagcgctgtgggcgccgagcccaacacctttggaattcccggcgtgaccgactacggccacttcctgaaagagatccccaacagcctggaaatcagacggaccttcgccgccaacctagagaaggccaacctgctgcctaagggcgaccccgagcggagaaggctgctgagcatcgtggtcgttggcggaggccccacaggcgtggaagctgctggcgagctgcaggattacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctcgatcaaggtgcacctgagaaccgctgtggccaaggtggaagagaagcagttgctggccaagaccaagcacgaggacggcaagattaccgaggaaaccattccctacggcaccctgatttgggccaccggcaacaaggcaagacccgtgatcaccgacctgttcaagaagatccccgagcagaacagcagcaagcggggcctggccgtgaatgacttcctgcaggtcaaaggcagcaacaacatcttcgccatcggcgacaacgcatttgccggcctgcctcctacagcccaggtggcccaccaggaagccgagtacctggccaagaactttgacaagatggcccagatccccaatttccaaaagaatctgtcctcacggaaggataagattgacctgctgttcgaggaaaacaacttcaagcccttcaagtacaacgacctgggcgccctggcctacctgggcagcgaaagggccattgccaccatcagaagcggcaagcggaccttctacaccggcggaggcctgatgaccttctacttatggcggatcatctacctgagcatgatcctatctgcccgcagcagactgaaggtgttcttcgactggatcaagttagccttcttcaagagggacttcttcaagggcctgtag

SEQ ID NO: 987 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggggtcgaaaacagcggggctggccccaccagcttcaagaccatgaagatcatcgacccccagcacagcgacaaaccaaacgtgctgatcctgggctctgggtggggcgccatcagctttctgaagcacatcgacaccaagaagtacaacgtcagcatcatcagccccagaagctacttcctgtacacccccctgctgcccagcgcccctgtgggaaccgtggacgagaagtccatcatcgagcccatcgtgaacttcgccctgaagaaaaagggcaacgtcacctactacgaggccgaagccaccagcatcaaccccgaccggaacaccgtgaccataaagagcctgagcgccgtgagccagctgtaccagcccgagaaccacctgggcctgcaccaagccgagcccgccgagattaagtacgactacctgatcagcgccgtgggcgccgagcccaacacctttggaatccccggcgtcaccgattacggccacttcctgaaagagatccccaactctttggaaatcagacggactttcgccgccaacctggaaaaggccaacctgttgcctaagggcgaccccgagcggagaaggctgctgagcatcgtggtcgtgggcggaggccctactggcgtggaggctgctggcgagctgcaggactacgtgcaccaggacctgcggaagttcctgcccgccctggccgaggaaatccagattcacctggtggaagctctgcccatcgtgctgaacatgttcgagaagaagctgagcagctacgcccagagccatctggaaaacacttccatcaaggtgcacctgagaaccgccgtggccaaggtggaagagaagcagctgctggccaagaccaagcacgaggacggcaagattaccgaagaaaccatcccctacggcaccctgatttgggccaccggcaacaaggccagacccgtgatcaccgacctgttcaagaagatccccgagcagaacagcagcaagcggggcctggccgtgaatgacttcctgcaggtcaaaggcagcaacaacatcttcgccatcggcgacaacgcctttgccggcctgcctccaaccgcccaagtggcccaccaggaagccgagtacctggccaagaacttcgacaagatggcccaaatccccaatttccagaagaatctgtcctccagaaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcctgtacatgtccatgatcctgagcgcccgcagcagactgaaggtgttcttcgactggatcaagctggccttcttcaagagggacttcttcaagggcctgtga

SEQ ID NO: 988 - DNA, 1542 bp, Artificial Sequence
  source: /note="Description of Artificial Sequence: Synthetic polynucleotide"
atgctaagcaagaacctgtacagcaacaagcggctgctgaccagcaccaacaccctcgtccgcttcgccagcaccagatccaccggcgtcgaaaacagcggggctggccccaccagcttcaagaccatgaaggtcatcgacccccagcacagcgacaagcccaacgtgctgatcctgggctctggctggggcgccatcagctttttaaagcacatcgacaccaagaagtacaacgtctccatcgtgagccccagaagctacttcctgttcacccccctgctgcccagcgcacctgtgggaaccgtggacgaaaagtccatcatcgagcccatcgtgaactttgccctgaagaaaaagggcaacgtcacctactacgaggccgaggccacctctatcaaccccgacaggaacaccgtgaccatcaagagcttaagcgccgtgtcccagctataccagcccgagaaccacctgggcctgcaccaggccgagcccgccgagattaagtacgactacctgatcagcgccgtgggcgccgagcccaacacctttggaatccccggcgtcaccgactacggccacttcctgaaagagatccccaacagcttggaaatccggcggaccttcgccgccaacctagaaaaggccaacctgctgccaaagggcgaccccgagcggagaaggctgctgtccatcgtggtcgtgggcggaggccccactggcgtggaagctgctggcgagctgcaggactacgtgcaccaggacctgcggaagttcctgcccgccctggccgaagaaatccagattcacctggtggaagccctgcccatcgtgctgaacatgttcgagaagaagctgtcaagctacgcccagagccacttagaaaacacctccatcaaggtgcacctgagaaccgccgtggccaaggtggaagagaagcagctgctggccaagaccaagcacgaggacggcaagattaccgaggaaactatcccctacggcaccttgatttgggccaccggcaacaaggccagacccgtgatcaccgacctgttcaagaagatccctgagcagaacagcagcaagcggggcctggccgtgaacgacttcctgcaggtcaaaggcagcaacaacatcttcgccatcggcgacaacgcctttgccggcctgcctccaacagcccaggtggcccaccaagaagccgagtacctggccaagaacttcgacaagatggcccagatccccaatttccagaagaacctgtcctcccggaaggataagatcgacctgctgttcgaggaaaacaacttcaagcccttcaagtacaacgacctgggcgccttagcctacctgggcagcgaaagagccattgccaccatcagaagcggcaagcggaccttttacaccggcggaggcctgatgaccttctacctgtggcggattatctacatgagcatgatcctgagcgcccgcagcagactgaaggtgtttttcgactggatcaagctggccttcttcaagagggacttcttcaagggcctgtga

SEQ ID NO: 989 - DNA, 1542 bp, Artificial Sequence
  source: /note="Description of Artificial Sequence: Synthetic polynucleotide"
atgctgagcaagaacctgtatagcaacaagcggctgctcaccagcaccaacaccctcgtgcgcttcgccagcaccagatccaccggcgtcgaaaacagcggggctggccccacctctttcaagaccatgaaggtcatcgacccccagcacagcgacaagcccaacgtgctgatcctgggctctgggtggggcgccatcagctttctgaagcacatcgacaccaagaagtacaacgttagcatcatcagccccagaagctacttcatctacacccccctgttacccagcgcccctgtgggaaccgtagacgagaagtccatcatcgagcccatcgtgaacttcgccctgaagaaaaagggcaacgtcacctactacgaggccgaagccaccagcatcaaccccgaccggaacaccgtgaccatcaagagcctgagcgccgtgtcccagctgtaccagcccgagaaccacctgggcctgcaccaggccgagcccgctgagattaagtacgactacctgatcagcgccgtgggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgagcggagaaggctgctgagcatcgtcgtcgtgggcggaggccccacaggtgtggaagctgctggcgagctgcaggactacgtgcaccaggacctgcggaagtttctgcccgccctggccgaggaaatccagattcacctggtggaagccctgcccatcgtgctgaacatgttcgagaagaagctgagcagctacgcccagagccatctggaaaacacctccatcaaggtacacctgagaacggccgtggccaaggtggaagagaagcagctgctggccaagaccaagcacgaggacggcaagattaccgaagaaactatcccctacggcaccttgatttgggccaccggcaacaaggccagacccgtgatcaccgaccttttcaagaagatccccgagcagaacagctccaagcggggcctggccgtgaacgacttcctgcaagtcaaaggcagcaacaacatcttcgccatcggcgacaatgcctttgccggcctgcctcctacagcccaggtggcccaccaggaagccgagtatctggccaagaatttcgacaagatggcccagatccccaatttccagaagaacctgtcctcccggaaggataagatcgacctgctgttcgaggaaaacaacttcaagcccttcaagtacaacgacctgggcgccctggcctacctgggaagcgaaagagccattgccaccatcagaagcggtaagagaaccttctacaccggcggaggcctgatgaccttctacctgtggcggatcatctacctgagcatgatcctgagcgcacgctcgagactgaaggtgttcttcgactggatcaagctggccttcttcaagagggacttcttcaagggcttatga

SEQ ID NO: 990 - DNA, 1542 bp, Artificial Sequence
  source: /note="Description of Artificial Sequence: Synthetic polynucleotide"
atgctgagcaagaacctgtatagtaacaagcggctgctgaccagcaccaacacgctcgtgcgcttcgctagcaccagatccaccggcgtcgaaaacagcggggctggccccaccagcttcaagaccatgaaggtcatcgacccccagcacagcgacaagcccaacgtgctgatactgggctcgggctggggagccatcagctttctgaagcacatcgacaccaagaagtacaacgtcagcatcgtgtctcccagaagctacttcctgtacacccccttgctgcccagcgcccctgtgggaaccgtggacgagaagtccatcatcgagcccatcgtgaacttcgctctgaagaaaaagggcaacgtcacctactacgaggccgaggccaccagcatcaaccccgaccggaacaccgtgaccatcaagagcctgagcgccgtgtcccagctgtaccagcccgagaaccacctgggcctgcaccaggccgagcccgccgagattaagtacgactacctgatcagcgccgtgggcgcggagcccaacacctttggaatccccggcgtgaccgactacggccatttcctgaaagagatccccaacagcctggaaatacggcggaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgagaaagttcctgcctgcactggccgaggaaatccagattcacctggtggaagccctgcccatcgtgttgaacatgttcgagaagaagctgagcagctacgcccagagccacctggaaaacacctccatcaaggtacacctgagaaccgccgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcaaaacagcagcaagcggggcctggccgtgaacgacttcctgcaggtcaaaggcagcaacaacatcttcgccatcggcgacaacgcatttgccggcctgcctcctacagcccaggtggcccaccaggaagccgagtacctggccaagaatttcgacaagatggcccagatccccaatttccagaagaacctgtcctcccggaaggataagatcgacctgctgttcgaggaaaacaacttcaagcccttcaagtacaacgacttaggcgccctggcctacctgggaagcgaaagagccattgcaaccatcagatccggcaagcggacattctacaccggcggaggcttaatgaccttctacctgtggcggattctgtacatgagcatgatcctgagcgcccgcagcagactgaaggtgttcttcgactggatcaagctggccttcttcaagagggacttcttcaagggcctgtga

SEQ ID NO: 991 - DNA, 1542 bp, Artificial Sequence
  source: /note="Description of Artificial Sequence: Synthetic polynucleotide"
atgctgagcaagaacctgtacagtaacaagcggctgctgaccagcaccaacaccctcgtgcgcttcgcctccaccagatccaccggcgtcgaaaactccggggctggccccaccagcttcaagaccatgaaagtcatcgacccccagcacagcgacaagcccaacgtgctgatcctgggctctggctggggagccatcagctttctgaagcacatcgacaccaagaagtacaacgtcagcatcgtgagccccagaagctatttcatctacacccccctgctgcccagcgcacctgtgggaaccgtggacgagaagtccatcatcgagcccatcgtgaacttcgctctcaagaaaaagggcaacgtcacctactacgaggccgaggccaccagcatcaaccccgaccggaacaccgtgaccatcaagtcactgtctgccgtgtcccagctgtaccagcccgagaaccacctgggcctgcaccaggccgagcccgccgagattaagtacgactacctgatcagcgccgtgggcgccgagcccaacacatttggaatccccggcgtgaccgactacggccacttcctgaaagagatccccaacagcctggaaatccggagaaccttcgccgccaacctggaaaaggccaacctgctgcctaagggcgaccccgaacggagaaggctgctgtccatcgtggtcgtgggcggaggccccacaggcgtggaagctgctggcgagctgcaggactatgtgcaccaggacctgcggaagttcctgcccgccctggccgaggaaatccagattcacctggtggaagccctgcccatcgtgttgaacatgttcgagaagaagctgagcagctacgcccagagccacctggaaaacacctccatcaaggtgcatctgagaacggccgtggccaaggtggaagagaagcagctgctggccaagaccaagcacgaggacggcaagattaccgaggaaaccatcccctacggcactctgatttgggccaccggcaacaaggccagacccgtaatcaccgacctgttcaagaagatccccgagcagaacagcagcaagcggggcctggccgtgaacgacttcctgcaggtcaaaggcagcaacaacatcttcgccatcggcgacaacgcctttgccggcctgccacctacagcccaagtggcccaccaagaagccgagtatctggccaagaacttcgacaagatggctcagatccccaatttccagaagaacctgtcttcccggaaggataagatcgacctgctgttcgaggaaaacaacttcaagcccttcaagtacaacgacctgggcgccctggcctacctgggcagcgaaagagccattgccaccatcagaagcggcaagcggaccttctacaccggcggtggcctgatgaccttctacctgtggcggatcctgtacctgagcatgatcctgagcgcccgcagcagactgaaggtgttcttcgactggatcaagctggccttcttcaaaagggacttctttaagggcctgtga

SEQ ID NO: 992 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgcctccaccagatccaccggcgtggaaaacagcggggctggtcccacctctttcaagaccatgaaggtcatcgacccccagcacagcgacaagcccaacgtgctgatcctgggctcgggctggggcgccatcagctttctgaagcacatcgacaccaagaagtacaacgtcagcatcatctctcccagaagctacttcctgtacacccccctgctgcccagcgccccagtgggaaccgtggacgaaaagtcaatcatcgagcccatcgtgaacttcgccctgaagaaaaagggcaacgtcacctactacgaggccgaagccaccagcatcaaccccgaccggaacaccgtgaccatcaagagcctgagcgccgtgagccagctgtaccagcccgagaaccacctgggcctgcaccaggccgagcccgccgagattaagtacgactacctgatcagcgccgtgggcgccgagcccaacacctttggaatccccggcgtgactgactacggccacttcctgaaagagatccccaacagcctggaaatccggcggaccttcgccgccaacctggaaaaggccaacctgttgcctaagggtgaccccgagcggagaaggctactgagcatcgtggtcgtgggcggaggccccacaggcgtggaagctgctggcgagctgcaggactacgtgcaccaggacctgcggaagttcctccccgccctggccgaggaaatccagattcacctggtggaagccctgcccatcgtgctgaacatgttcgagaagaagctgagcagctacgcccagagccacctggaaaacacttcgatcaaggtgcacctgagaaccgctgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgactttttgcaagtcaaaggcagcaacaacatcttcgccatcggcgacaacgcctttgccgggctgcctcctacagcccaggtggcccaccaggaagccgagtacctggccaagaacttcgacaagatggcccagatccccaatttccagaagaacctgtcctcccggaaggataagatcgatctgctgttcgaggaaaacaacttcaagcccttcaagtacaacgacctgggcgccctggcctacctgggctccgaaagagccattgccaccatcagaagcggcaagcggaccttctacaccggcggtggcctgatgaccttctacctgtggcggatcatctacatgagcatgatcctaagcgcccgcagcagattaaaggtgtttttcgactggatcaagctggccttcttcaagagggacttcttcaagggcctgtga

SEQ ID NO: 993 - DNA, 1542 bp, Artificial Sequence
  source: /note="Description of Artificial Sequence: Synthetic polynucleotide"
atgctgagcaagaatctgtatagcaacaagcggctgctgaccagcaccaataccctcgtgcgcttcgccagcaccagatccaccggggtcgaaaacagcggggctggccccaccagcttcaagaccatgaagatcattgacccccagcacagcgacaagcccaacgtgctgatactgggctcgggctggggcgccatcagctttctgaagcacatcgacaccaagaagtacaacgtcagcatcgtgagccccagaagctacttcctgtacacccccttgctgcccagcgcccctgtgggaaccgtggacgagaagtccatcattgagcccatcgtgaacttcgccctgaagaaaaagggcaacgtcacctactacgaggccgaggccaccagcatcaaccccgaccggaacaccgttaccatcaagagcctgagcgccgtgtcccagctgtaccagcccgagaaccacctgggcctgcaccaggccgagcccgccgagattaagtacgactacctgatcagcgccgtgggcgccgagcccaacacctttggaatccctggcgtgaccgactacggccatttcctgaaagagatccccaacagcctggaaatccggcggacctttgccgccaacctggaaaaggccaacctgctgcctaagggcgaccccgagcggagaagactgctgtccatcgtggtcgtgggcggaggccccacaggcgtggaagctgctggcgagctgcaggactacgttcaccaggacctgcggaagttcctgcccgccctggccgaagaagtgcagattcacctggtggaagccctgcccatcgtgctgaacatgtttgagaagaagcttagcagctacgcccagagccacctggaaaacacctccatcaaggtgcacctgagaaccgccgtggccaaggtggaagagaagcagctgctggccaagaccaagcacgaggacggcaagataaccgaggaaactatcccctacggcaccctgatttgggccaccggcaacaaggccagacccgtgatcaccgacctgttcaagaaaatccctgagcagaacagcagcaagcggggcctggccgtgaacgacttcctgcaggtcaaaggcagcaacaacatcttcgccatcggcgacaacgcatttgccggcctgcctcctacagcccaggtggcccaccaagaagccgagtacctggccaagaacttcgacaagatggcccagatccccaatttccagaagaacctatcctcccggaaggataagattgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggagaatcctgtacatgagcatgattctgagcgcccgcagcagactgaaggtgttcttcgactggatcaagctggccttcttcaagagggacttcttcaagggactgtga

SEQ ID NO: 994 - DNA, 1542 bp, Artificial Sequence
  source: /note="Description of Artificial Sequence: Synthetic polynucleotide"
atgctgagcaagaacctgtacagcaacaagcggctgctgaccagcaccaacaccctcgtgcgcttcgccagcaccagatccaccggggtcgaaaacagcggggcaggccccaccagcttcaagaccatgaagatcattgacccccagcacagcgacaagcccaacgtgctgatcctgggctctggctggggcgctatctcgtttctgaagcacattgacaccaagaagtacaacgtcagcatcgtgagccccagaagctacttcctgttcacgcccttgctgcccagcgcccctgtggggacagtagacgagaagtccatcatcgagcccatcgtgaacttcgccctgaagaaaaagggcaacgtcacctactacgaggccgaggccaccagcatcaaccccgaccggaacaccgtgaccatcaagagcctgagcgccgtgtcccagctgtaccaacccgagaaccacctgggcctgcaccaggccgagcccgccgagattaagtacgactacctgatcagcgctgtgggcgccgagcccaacacatttggaatccccggcgtcaccgactacggccacttcctgaaagagatccccaacagcctggaaatccggagaaccttcgccgccaacctggaaaaggccaacctgctgcctaagggcgaccccgagcggagaaggctactgagcattgtggtcgtgggcggaggccccacaggcgtggaagctgctggcgagctgcaggactacgttcaccaggacctgcggaagttcctgcccgccctggccgaggaaatccagattcacctggtcgaagccctgcccatcgtgctgaacatgttcgagaagaagctgagcagctacgcccaatcacacttagaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggtaacaaggccagacccgtgatcaccgacctgttcaagaagatccctgagcagaacagcagcaagcggggcctggccgtgaacgacttcctgcaagtcaaaggcagcaacaacatcttcgccatcggcgacaacgcctttgccggcctgcctccaacagcccaggtggcccaccaggaagccgagtacctggccaagaacttcgacaagatggcccagatcccaaatttccaaaagaacctgtcctcccggaaggataaaatcgacctgctgttcgaggaaaacaacttcaagcccttcaagtacaacgacctgggcgccctggcctacctgggcagcgaaagagccattgccaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttcttcaagggcctgtga

SEQ ID NO: 995 - DNA, 1542 bp, Artificial Sequence
  source: /note="Description of Artificial Sequence: Synthetic polynucleotide"
atgctgagcaagaacctgtatagcaacaagaggctgctgaccagcaccaacacgctcgtgcgcttcgccagcaccagatccacaggcgtggaaaacagcggggctggccccaccagcttcaagaccatgaaggtcatcgacccccagcacagcgacaaacccaacgtgctgatcctgggctcgggctggggcgccatctcgtttctgaagcacatcgacaccaagaagtacaacgtcagcatcgtgagccccagaagctacttcatcttcacccccctgctgcccagcgcccctgtgggaaccgtggacgagaagtccatcatcgagcccatcgtgaacttcgccctgaagaaaaagggcaacgtcacctactacgaggccgaggccaccagcatcaatcccgaccggaacaccgtgaccatcaagagcctgagcgccgtgtcccagctgtaccagcccgagaaccacctggggctgcaccaggccgaacccgccgagattaagtacgactacctgatcagtgccgtgggcgccgagcccaacacctttggaatccccggcgtgaccgactacggccacttcctgaaagagatccccaacagcttggaaatccggcggaccttcgccgccaacctggaaaaggccaacctgctgcctaagggcgaccccgagcggagaagactgctgagcatcgtggtcgttggcggaggccccacaggcgtggaagctgctggcgagctgcaggactacgtgcaccaggacctgcggaagttcctccctgccctggccgaggaaatccagattcacctggtggaagccctgcccatcgtgctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaaaattaccgaggaaactatcccctacggcaccttgatttgggccaccggtaacaaggcaagacccgtgatcaccgacctgttcaagaagatccccgagcagaacagcagcaagagaggcctggccgtgaacgacttcctgcaggtcaaaggcagcaacaacatcttcgccatcggcgacaacgcctttgctggcctgcctcctacagcccaggtggcccaccaggaagccgagtacctggccaagaactttgacaagatggcccagatccccaatttccagaagaacctgtcctcccggaaggataagatcgacctgctgttcgaggaaaacaactttaagcccttcaagtacaacgacttaggcgccctggcctacctgggcagcgaaagggccattgccaccatcagaagcggcaagcggaccttctacaccggcggaggcctgatgaccttctacctgtggcggatcatctacatgagcatgatcctgagcgcccgcagcagactgaaggtgttcttcgactggatcaaactggccttcttcaagagggacttcttcaagggcttatga

SEQ ID NO: 996 - DNA, 1542 bp, Artificial Sequence
  source: /note="Description of Artificial Sequence: Synthetic polynucleotide"
atgctgagcaagaacctgtacagcaacaagaggctgctgaccagcaccaacaccctcgtgcgcttcgccagcaccagatccaccggcgtcgaaaacagcggggctggccccaccagctttaagaccatgaagatcatcgacccccagcacagcgacaagcccaacgtgctgatactgggctctggctggggcgccatcagctttctgaagcacatcgacaccaagaagtacaacgtcagcatcatcagccccagaagctacttcatctacacccccctgctgcctagcgcccctgttggaaccgtagacgagaagtccatcatcgagcccatcgtgaacttcgccctgaagaaaaagggcaacgtcacctactacgaggcagaagccaccagcatcaaccccgaccggaacaccgtgaccatcaagagcctgagcgccgtgagccagctgtaccagcccgagaaccacctgggcctgcaccaggccgagcccgccgagattaagtacgactacctgatcagcgccgtgggcgccgagcccaacacctttggaatccccggcgtgaccgactacggccatttcctgaaagagatccccaacagcctggaaatccggagaaccttcgccgccaacctagagaaggccaacctgctgcctaagggcgaccccgagcggagaaggctgctgagcatcgtggtcgtgggcggaggccccacaggcgtggaagccgctggcgagctgcaggactacgtgcaccaggacctgcggaagtttctgcccgccttggccgaggaaatccagattcacctggtggaagccctgcccatcgtgctgaacatgttcgagaagaagctgagcagctacgcccagagccacctggaaaacacctccatcaaagtacacctgagaaccgccgtggccaaggtggaagagaagcagctgctggccaagaccaagcacgaggacggcaagattaccgaggaaaccattccctacggcaccctgatttgggccaccggcaacaaggccagacccgtgatcaccgacctgttcaagaagatccccgagcagaacagcagcaagcggggcctggccgtgaacgacttcctgcaagtcaaaggcagcaacaacatcttcgccatcggcgacaacgcctttgccgggctgcctcctacagcccaggtggcccaccaggaagccgagtatctggccaagaacttcgacaagatggcccaaatccccaatttccagaagaacctgtcttcccggaaggataagatcgatctgctgttcgaggaaaacaacttcaaacccttcaaatacaacgacctgggcgccctggcctacctgggcagcgaaagagccattgccaccatcagaagcggcaagcggaccttctacaccggcggaggcttaatgaccttctacctgtggcggatcatctacctgagcatgatcctaagcgcccgcagcagactgaaggtgttcttcgactggatcaagctggccttcttcaagagggacttcttcaagggcctgtga

SEQ ID NO: 997 - DNA, 1542 bp, Artificial Sequence
  source: /note="Description of Artificial Sequence: Synthetic polynucleotide"
atgctgagcaagaacctgtacagcaacaagcggttgctgaccagcaccaacaccctcgtgcgcttcgccagcaccagatccaccggcgtcgaaaacagcggggctggccccaccagcttcaagaccatgaaggtcatcgacccccagcacagcgacaagcccaacgtgctgatcctgggctcgggctggggagccatcagctttctgaagcacatcgacaccaagaagtacaacgtcagcatcgtgagccccagaagctatttcatctacacccctttgctgcccagcgcccctgtgggaaccgtggacgaaaagtccatcatcgagcccatcgtgaacttcgccctgaagaaaaaggggaacgtcacctactacgaggccgaggccaccagcatcaaccccgacaggaacaccgtgaccatcaagagcctgagcgccgtgtcccagctgtaccagcccgagaaccacctgggcctgcaccaggccgagcccgccgagattaagtacgactacctgatcagcgctgtgggcgcggagcccaacacctttggaatccccggcgtgaccgattacggccacttcctgaaagaaatccccaacagcctggaaatccggcggaccttcgccgccaacctggaaaaggccaacctgctgcctaagggcgaccccgagcggagaaggctgctgtccattgtggtcgttggcggaggccctacaggcgtggaagctgctggcgagctgcaggactacgtgcaccaggacctgcggaagttcctgcccgccttggccgaggaaatccagattcacctggtggaagccctgcccatcgtgctgaacatgttcgagaagaagctgagcagctacgcccagtcacacctggaaaacacctccatcaaggtgcacctgagaaccgccgtggccaaggttgaagagaagcagctgttggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcttggccgtgaatgacttcttgcaggtcaaaggcagcaacaacatcttcgccatcggcgacaacgcctttgccggcctgcctcctacagcccaggtggcccaccaggaagccgagtacctggccaagaacttcgacaagatggctcagatccccaatttccagaagaacctgtcttcccggaaggataagatcgacctcctgttcgaggaaaacaacttcaagcccttcaagtacaacgacctgggcgccctggcctacctgggctccgaaagagccattgccaccatcagaagcggcaagcggaccttctacaccggcggaggcctgatgaccttctacctgtggcggatcctgtacatgagcatgatcctaagcgcccgcagcagactgaaggtgttcttcgactggatcaagttagccttcttcaagagggacttcttcaagggcctgtga

SEQ ID NO: 998 - DNA, 1542 bp, Artificial Sequence
  source: /note="Description of Artificial Sequence: Synthetic polynucleotide"
atgctatcgaagaatctgtacagtaacaagcggctgctcaccagcaccaacaccctagtgcgcttcgccagcaccagatccaccggcgtcgaaaacagcggggcaggccccaccagcttcaagaccatgaagatcattgacccccagcacagcgacaagcccaacgtgctgatcctgggctctggctggggcgccatctcgtttctgaagcacatcgacaccaagaagtacaacgttagcatcgtgagccccagaagctacttcctgtacacccctctgctgccctctgcccctgtgggaaccgtggacgagaagtccatcatcgagcccatcgtgaactttgccctgaagaaaaagggcaacgtcacctactacgaggccgaggccaccagcatcaaccccgaccggaacaccgtgaccatcaagagcctgagcgccgtgagccagctgtaccagcccgagaaccacctgggcctgcaccaggccgagcccgccgagattaagtacgactacctgatcagcgccgtgggcgccgagcctaacacatttggaatccccggcgtgaccgactacggccacttcctgaaagagattcccaacagcctggaaatccggagaaccttcgccgccaacctggaaaaggccaacctgctgcctaagggtgaccccgagcggagaaggctgctgagcatcgtggtcgtgggcggtggccccacaggcgtggaagctgctggcgagctgcaggactacgtgcaccaggacctgagaaagttcctgcccgccctggccgaagaaatccagattcacctggtggaagccctgcccatcgtgctgaacatgttcgagaaaaagctgagcagctacgcccagagccacctggaaaacacctccatcaaggtgcacctgagaaccgccgtggccaaggtggaagagaagcagttgctggccaagaccaagcacgaagacggcaagattaccgaggaaaccatcccctacggcaccctgatttgggccaccggtaacaaggccagacccgtgatcaccgacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcccaccaggaagccgagtacctggccaagaacttcgacaagatggcccagatccccaatttccagaagaacctatcctcccggaaggataagatcgacctgctgttcgaggaaaacaacttcaagcccttcaagtacaacgacctgggtgccctggcctacctgggcagcgaaagagccattgccaccatcagaagcggcaagcggaccttctacaccggcggaggcctgatgaccttctacctgtggcggatcctgtacatgagcatgatcctgagcgcccgctcgagactgaaggtgttcttcgactggatcaagctggcattcttcaagagggacttcttcaagggcctgtga

SEQ ID NO: 999 - DNA, 1542 bp, Artificial Sequence
  source: /note="Description of Artificial Sequence: Synthetic polynucleotide"
atgctgtcgaagaacctgtacagcaacaagcggctgctgaccagcaccaacaccctcgtgcgcttcgccagcaccagatccaccggcgtcgaaaacagcggggctggccccaccagcttcaagaccatgaagatcatcgaccctcagcacagcgacaagcccaacgtgctgatcctgggctctggctggggcgccattagctttctgaagcacatcgacaccaagaagtacaacgtctccatcgtgagccccagaagctacttcctgtacacccccttgctgcccagcgcccctgtggggacagtggacgaaaagtccatcatcgagcccatcgtgaacttcgctctgaagaaaaagggcaacgtcacctactacgaggccgaggccaccagcatcaaccccgaccggaacaccgtgaccatcaagtcactgagcgccgtgtcccagctgtaccagcccgagaaccacctgggcctgcaccaagccgaacccgccgagattaagtacgactacctgatcagcgccgtgggcgccgagcccaacacatttggaatccccggcgtgaccgactacggccacttcctgaaagagatccccaacagcttggaaatccggagaaccttcgccgccaacctggaaaaggctaacctgctgcctaagggcgaccccgagcggagaaggctgctgagcatcgtggtggtgggcggaggccccacaggcgtggaggctgctggcgaactgcaggactacgtgcaccaggacctgcggaagttcctgcccgccctggccgaggaagtgcaaattcacctggtggaagccctgcccatcgttctgaacatgttcgagaagaagctgagcagctacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccttgatttgggccaccggcaacaaggccagacccgtgatcaccgacctgttcaagaagatccccgagcagaacagcagcaagcggggcctggccgtgaacgacttcctgcaagtcaaaggcagcaacaacattttcgccatcggcgacaacgcctttgccggcctgcctcctacagcccaggtggcccaccaggaagccgagtacctggccaagaacttcgacaagatggcccagatccccaatttccagaagaacctatcctcccggaaggataagatcgacctgctgttcgaggaaaacaacttcaagcccttcaagtacaacgatctgggcgccttagcctacctgggcagcgaaagagccattgccaccatccgtagcggcaagcggaccttctacaccggcggaggcctgatgaccttctacctgtggcggatcatctacatgagcatgatcctgagcgcccgcagcagactgaaggtgttcttcgactggatcaagctggcctttttcaagagagacttcttcaagggcctgtga

SEQ ID NO: 1000 - DNA, 1542 bp, Artificial Sequence
  source: /note="Description of Artificial Sequence: Synthetic polynucleotide"
atgctgtcgaagaacctgtacagcaacaagcggctgctgaccagcaccaacaccctcgtccgcttcgccagcaccagatccaccggggtcgaaaacagcggggctggccccaccagcttcaagaccatgaagatcatcgacccccagcacagcgacaagccaaacgtgctgatcctgggctctggctggggcgccatcagctttttaaagcacattgacaccaagaagtacaacgtcagcatcgtgagccccagaagctacttcatcttcacgcccctgctgcccagcgcccctgtgggaaccgtggacgagaagtccatcatcgagcccatcgtgaactttgctctgaagaaaaagggcaacgtcacctactacgaggccgaggccaccagcatcaaccccgaccggaacaccgtgaccataaagagcctgagcgccgtgagccagctgtaccagcccgagaaccacctgggcctgcaccaagccgagcccgccgagattaagtacgactacctgatcagcgccgtgggcgccgagcccaacacctttggaatccccggcgtgactgactacggccatttcctgaaagagatccccaacagcctggaaatccggagaaccttcgccgccaacctggaaaaggccaacctgctgcctaagggcgaccccgagcggagaaggctgctgagcatcgtggtcgtgggcggaggccccacaggcgtggaagctgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccagagccacctggaaaacacctccatcaaggtgcacctgagaaccgctgtggccaaggtggaagagaagcagctgctggcaaagacgaagcacgaggacggcaagataaccgaggaaactatcccctacggcaccctgatttgggccaccggcaacaaggccagacccgtgatcaccgacctgttcaagaagatccccgagcagaacagcagcaagcggggcctggcagtgaacgacttcctgcaggtcaaaggcagcaacaacatcttcgccatcggcgacaacgcctttgccggcctgccacctacagcccaagtggcccaccaggaagccgaatacctggccaagaacttcgacaagatggcccagatccccaatttccagaagaacctgtcctcacggaaggataagatcgacctgctgttcgaggaaaacaactttaagcccttcaagtacaacgacctgggcgccctggcctacctgggcagcgaaagagccattgccaccatcagaagcggtaagcggaccttctacaccggcggaggcttaatgaccttctacctgtggcggatcctgtacatgagcatgattctgagcgcccgcagcagactgaaggtgttcttcgactggatcaagctggccttcttcaagagggacttcttcaagggcctgtag

SEQ ID NO: 1001 - DNA, 1542 bp, Artificial Sequence
  source: /note="Description of Artificial Sequence: Synthetic polynucleotide"
atgctgagcaagaacctgtacagcaacaagcggttgctgaccagcaccaacaccctcgtgagattcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtctccatcgtgagccccagaagctacttcatcttcacccctctgctgccctctgcccctgtgggaaccgtggacgagaagtccatcattgagcccatcgtgaacttcgccctgaagaaaaagggcaacgtcacctactacgaggccgaggccaccagcatcaaccccgaccggaacaccgtgaccatcaagagcttaagcgccgtgtcccagctgtaccagcccgagaaccacctgggcctgcaccaggccgagcccgccgagattaagtacgactatctgatcagcgccgtgggcgccgaacccaacacctttggaattcccggcgtcaccgattacggccacttcctgaaagagatccccaacagcctggaaatccggcggaccttcgccgccaacctggaaaaggccaacctgctgcctaagggtgaccccgaacggagaaggctgctgagcatcgtggtcgttggcggaggccccacaggcgtggaagccgctggcgagctgcaggactacgtgcaccaggacctgcggaagttcctgcccgccctggccgaggaaatccagattcacctggtggaagccctgcccatcgtgctgaacatgttcgagaagaagctgagcagctacgcccaatcacatctggaaaacacctccatcaaggtgcacctgagaaccgctgtggccaaggtggaagagaagcagctgctggccaagaccaagcacgaggacggcaagattaccgaggaaaccatcccctacggcaccctgatttgggccaccggcaacaaggccagacccgtgatcaccgacctgttcaagaagatccccgagcagaacagcagcaagcggggcctggccgtgaacgacttcctgcaggtcaaaggcagcaacaacatcttcgccatcggcgacaatgcctttgccggcctgcctcctacagcccaggtggcccaccaagaagccgagtacctggccaagaacttcgacaagatggcccagatcccaaatttccagaagaacctgtcctcccggaaggataagatcgacctgctgttcgaggagaacaacttcaagcctttcaagtacaacgacctgggcgccttagcctacctgggcagcgaaagagccattgccaccataagaagcggcaagcggaccttctacaccggcggaggcctgatgaccttctacctgtggcggatcatctacctgagcatgatcctgagcgccagaagcagactgaaggtgttcttcgactggatcaagctggccttcttcaaaagggacttctttaagggcctgtga

SEQ ID NO: 1002 - DNA, 1542 bp, Artificial Sequence
  source: /note="Description of Artificial Sequence: Synthetic polynucleotide"
atgctgagcaagaacctgtatagcaacaagcggctgctgaccagcaccaacaccctcgtgcgcttcgccagcaccagatccaccggcgtcgaaaacagcggggctggccccaccagcttcaagaccatgaagatcatcgacccccagcacagcgacaagcccaacgtgctgatcctgggctctggctggggcgccatcagctttctgaagcacatcgacaccaagaagtacaacgtcagcatcgtgtctcccagaagctatttcatcttcacccccctgctgcccagcgcacctgtgggaaccgtggacgaaaagtccatcatcgagcccatcgtgaacttcgccctgaagaaaaagggcaacgtcacctactacgaggccgaggccacctctatcaaccccgaccggaacaccgtgaccatcaagagcctgagcgccgtgtcccagctgtaccagcccgagaaccacctgggcctgcaccaggcagagcccgccgaaattaagtacgactacctgatcagcgccgtgggtgccgagcccaacacctttggaatccccggggtcaccgactacggtcacttcctgaaagagatccccaacagcctggaaatccggcggaccttcgccgccaacctagagaaggccaacctgctgcctaagggcgatcccgagcggagaaggctgctgagcatcgtggtcgtgggcggaggccccacaggcgtagaagctgctggcgagctgcaggactacgtgcaccaggacctgagaaagttcctgcccgccctggccgaggaaatccagattcacctggtggaagctctgcccatcgtgctgaacatgttcgagaagaagctgagcagctacgcccagagccacctggaaaacacctccatcaaggtgcacctgagaacggccgtggccaaggtggaagaaaagcagttgctggcaaagaccaagcacgaggacggcaagattaccgaggaaaccatcccctacggcactctgatttgggccaccggtaacaaggccagacccgtgatcaccgacctgttcaagaagatccccgagcagaacagcagcaagcggggcttggccgtgaacgacttcctgcaggtcaaaggcagcaacaacatcttcgccatcggcgacaacgcctttgccggcctgcctcctacagcccaggtggcgcaccaggaagccgagtacctggccaagaacttcgacaagatggcccagatccccaatttccagaagaacctgtcctcccggaaggataagattgacctgctgttcgaggaaaacaacttcaagcccttcaagtacaacgacctgggtgccctggcctacctgggcagcgaaagagccattgcaaccatcagaagcggcaagcggaccttctacaccggcggaggcctgatgaccttctacctgtggcggatcatctacctgagcatgatcctgagcgcccgcagcagactgaaggtgttcttcgactggatcaagctggccttcttcaagagggacttctttaagggcctgtga

SEQ ID NO: 1003 - DNA, 1542 bp, Artificial Sequence
  source: /note="Description of Artificial Sequence: Synthetic polynucleotide"
atgctgagcaagaacctgtacagcaacaagcggctgctgaccagcaccaacacgctagtgcgcttcgcctccaccagatccaccggggtcgaaaacagcggggctggccctaccagcttcaagaccatgaaggtcatcgacccccagcacagcgacaagcccaacgtgctgatcctgggctctggctggggcgccatcagctttctgaagcacatcgacaccaagaagtacaacgtcagcatcatcagccctagaagctacttcatctacacccccctgctgcctagcgcccctgtgggaaccgtggacgagaagtccatcatcgagcccatcgtgaatttcgccctgaagaaaaagggcaacgtcacctactacgaggccgaggccacctctatcaaccccgaccggaacaccgtgaccatcaagagcctgtctgccgtgtcccagctgtaccagcccgagaaccacctaggcctgcaccaggccgagcccgctgagattaagtacgactacctgatcagcgccgtgggcgccgagcccaacacctttggaatccccggcgtcaccgactacggccacttcctgaaagagatccccaacagcctggaaatccggcggaccttcgccgccaatctggaaaaggccaacttactgcctaagggcgaccccgagcggagaaggctgctgagcatcgtggtcgtgggcggaggccccacaggcgtggaagctgctggcgagctgcaggactacgtgcaccaggacctgcggaagttcctgcccgccttggccgaggaaatccagattcacctggtggaagccctgcccatcgtgctgaacatgttcgagaagaagcttagcagctacgcccagagccacctggaaaacacctcgatcaaggtgcacctgagaaccgccgtggccaaagttgaagagaagcaactgctggccaagaccaagcacgaggacggcaagattaccgaggaaaccatcccctacggcaccctgatttgggccaccggcaacaaggccagacccgtgatcacagacctgttcaagaagatccccgagcagaacagcagcaagcggggcctggccgtgaacgacttcctgcaggtcaaaggcagcaacaacatcttcgccatcggcgacaacgcctttgccggcctgcctcctacagcccaggtggcgcaccaggaagccgagtacctggccaagaacttcgacaagatggcccagatccccaatttccaaaagaatctgtcctcccggaaggataagatcgacctgctgttcgaggaaaacaacttcaagcccttcaagtacaacgacctgggcgccctggcatacctgggatccgaaagagccattgccaccatcagaagcggcaagcggaccttctacaccggcggaggcctgatgaccttctacctgtggcggatcatctacatgagcatgattctgagcgcccgcagcagattaaaggtgttcttcgactggatcaagctggccttcttcaagagggacttcttcaagggcctgtga

SEQ ID NO: 1004 - DNA, 1542 bp, Artificial Sequence
  source: /note="Description of Artificial Sequence: Synthetic polynucleotide"
atgctgtcgaagaacctgtacagcaacaagcggctgctgacctcgaccaacacgctcgtgcgcttcgccagcaccagatccacaggcgtcgaaaacagcggggctggccccaccagcttcaagaccatgaaggtcattgacccccagcacagcgacaagcccaacgtgctgatcctgggctcgggctggggcgccatctcgtttttaaagcacatcgacaccaagaagtacaacgtcagcatcatcagccccagaagctacttcatctacacccccttgctgcccagcgcccctgtgggaaccgtggacgagaagtccatcatcgagcccatcgtgaacttcgccctgaagaaaaagggcaacgtcacctactacgaggccgaggccaccagcatcaaccccgaccggaacaccgttaccatcaagagcctgagcgccgtgtcccagctgtaccagcccgagaaccacctgggcctgcaccaggccgagcctgccgagattaagtacgactacctgatcagcgccgtaggcgccgagcccaacacctttggaatccccggcgtgaccgactacggccacttcctgaaagagatccccaacagcctggaaatccggcggaccttcgccgccaacctggaaaaggccaacctgctgcctaagggcgaccccgaacggagaaggctgctgagcatcgtggtggttggcggaggccccacaggtgtggaagctgctggcgagctgcaggactatgtgcaccaggacctgcggaagttcctgcccgccctggccgaggaaatccaaattcacctggtggaagccctgcccatcgttctgaacatgttcgagaagaagctgagctcatacgcccagagccacctggaaaacacctccatcaaggtgcacctgagaaccgccgtggccaaggtggaagagaagcagctgctggccaagaccaagcacgaggacggcaagattaccgaggaaaccatcccctacggcaccctgatttgggccaccggcaacaaggccagacccgtaatcaccgacctgttcaagaagatccccgagcagaacagcagcaagcggggcctggccgtgaacgactttctgcaagtgaaaggcagcaacaacatcttcgccatcggcgacaacgcatttgccggcttgcctcctacagcccaggtggcccaccaggaagccgagtacctggccaagaatttcgacaagatggcccagatccccaatttccagaagaacctgtcctcccggaaggataagatcgacctgctgttcgaggaaaacaacttcaagcccttcaagtacaacgacctgggcgccctggcctacctgggctccgaaagagccattgccaccatcagaagcggcaagagaaccttctacaccggcggaggcctgatgaccttctacctgtggcggatcatctacatgagcatgatcctgagcgccagaagcagactgaaggtgttcttcgactggatcaagctggccttcttcaagagggacttcttcaagggcctgtga

SEQ ID NO: 1005 - DNA, 6697 bp, Artificial Sequence
  source: /note="Description of Artificial Sequence: Synthetic polynucleotide"
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggcccgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacgggccctctagactcgaggtagggtgtcagtttcatcacatcatcgaattacacgtttacccaagagaagaaactaaaaaccactatgctatcgaagaatttgtatagtaacaagaggttgctcacctcgacgaatacgctagtcagattcgcttccaccagatccacaggggtggaaaactccggagcaggtcctacatcttttaagaccatgaaagtcattgaccctcagcacagcgacaaaccaaacgtgctgatactgggttcgggtggggagctatttcgtttttaaagcacattgacaccaagaagtacaacgtttccatcatctctcctagaagctatttcttatttacgcctttgttaccttctgcaccagttgggacagtagacgaaaagtcaattattgagcccatcgttaattttgctctcaagaaaaaggggaacgttacctactatgaggcagaagccacctctatcaatcccgacaggaataccgttaccataaaatcattatctgccgttagccagctataccaacctgaaaaccatctagggctgcatcaagcagaacctgctgaaattaagtacgattatttaatcagtgctgtaggtgcggaacctaacacatttggtattcctggggtcactgattacggtcatttcctgaaggaaattcccaactctttggaaataagaagaacttttgccgccaatctagagaaggctaacttattgccaaagggtgatcccgaaagaagaagactactgtccattgtcgtggttggtggtgggcctactggtgtagaggccgctggtgaactacaggattatgttcaccaggacctgagaaagtttctccctgcattggccgaagaagtccaaattcacttggtcgaagctctgcccatcgttttgaatatgtttgagaaaaagctttcatcatacgcgcaatcacatttagaaaacacttcgatcaaagtacatctgagaacggctgtcgccaaagttgaagaaaagcaattgttggcaaagacgaaacacgaagacggtaaaataaccgaagaaactattccatacggtactttgatttgggccacgggtaacaaggcaagaccggtaatcacagaccttttcaagaaaattcctgagcaaaactcgtccaagagaggattggcagtgaatgactttttgcaagtgaaaggcagcaacaacattttcgccattggtgacaatgcatttgctgggttgccaccaaccgcccaagtggcgcaccaagaggccgaatatttggccaagaattttgataaaatggctcaaataccaaatttccaaaagaatctatcttcaagaaaggataaaattgatctcttgttcgaggagaacaactttaaacctttcaaatacaacgatttaggtgccttagcatacctgggatccgaaagggccattgcaaccatacgttccggtaagagaacattttacaccggtggtggcttaatgaccttctacttatggagaattttgtacttgtccatgattctatctgcaagatcgagattaaaggtctttttcgactggattaaattagcatttttcaaaagagacttttttaaaggattatagatgaaattaacatgcccttttctggaaaaaggaaaaaaggtggtaggcaccgttttttcctgagtttgcatccttttttttctaaaaccctctaaacaaaacctaacacacacacacacgcacaaaaaaatgcacatgatgttttattatttatatattcccacttttttcgaaatgatgcttgactaatgcacaagcaaaaaaccccgacaagattggttgatcactgcggccgcaataaaggaaatttattttcattgcaatagtgtgttggttttttgtgtggataaacgggccctctagacagcggcctccgcgccgggttttggcgcctcccgcgggcgcccccctcctcacggcgagcgctgccacgtcagacgaagggcgcaggagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgtggcacagctagttccgtcgtctagactcgagatgaagttatgggatgtcgtggctgtctgcctggtgctgctccacaccgcgtccgccttcccgctgcccgccggtaagaggcctcccgaggcgcccgccgaagaccgctccctcggccgccgccgcgcgcccttcgcgctgagcagtgactcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctgactcgagcggccgccactgtgctggatgggactctcgcgataactgtactgagataaagtgtggcaactcgaaaaaaaaaaaaaaaaaaaaaaaaaaaaaaaaaaaaaagaaaaaaaaaaaaaaaaagggcggccatctgcaaaattccaccacactggactagtggatccgagctcggtacggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 1006 - protein, 27 aa, Artificial Sequence
  mitochondrial localisation sequence; synthetic polypeptide
MLSKNLYSNKRLLTSTNTLVRFASTRS

SEQ ID NO: 1007 - protein, 29 aa, Artificial Sequence
  mitochondrial localisation sequence; sythetic polypeptide
MSVLTPLLLRGLTGSARRLPVPRAKIHSL

SEQ ID NO: 1008 - DNA, 20 bp, Artificial Sequence
  source: Description of Artificial Sequence: hNDI1 forward primer
gaacaccgtgaccatcaaga

SEQ ID NO: 1009 - DNA, 20 bp, Artificial Sequence
  source: Description of Artificial Sequence: hNDI1 reverse primer
gctgatcaggtagtcgtact

The invention claimed is:

1. An isolated nucleic acid sequence encoding an immune optimised functional variant of the yeast NDI1 protein, wherein the amino acid sequence of the variant is either
   (i) the sequence shown as SEQ ID NO: 542 with at least one conservative amino acid change to a residue selected from the group consisting of: K284, S143, L502, L403, A387, S86, L19, K214, K373, K511, L159, R479, L483, I82, F90, L89, V266, L481, L202, L259, L150, R85, Y151, Y482, S488, V45, S80, and K196, and with no amino acid changes to residues other than the residues of said group and with no amino acid change other than a conservative amino acid change to said residues of said group, wherein a conservative amino acid change is a change for which the change in BLOSUM score is 4 or less or
   (ii) the sequence shown as residues 28 to 513 of SEQ ID NO: 542 with at least one conservative amino acid change to a residue selected from the group consisting of: K284, S143, L502, L403, A387, S86, K214, K373, K511, L159, R479, L483, I82, F90, L89, V266, L481, L202, L259, L150, R85, Y151, Y482, S488, V45, S80, and K196, and with no amino acid changes to residues other than the residues of said group and with no amino acid change other than a conservative amino acid change to said residues of said group; wherein a conservative amino acid change is a change for which the change in BLOSUM score is 4 or less.

2. The isolated nucleic acid sequence of claim 1, wherein the at least one conservative amino acid change is made to a residue selected from the group consisting of: K284, S143, L502, L403, A387, S86, F90, K214, K373, L259, K511, L159, R479, L483, I82, L89, V266, L481, L202, L150, R85, Y151, Y482, S488, V45, S80, and K196.

3. The isolated nucleic acid sequence of claim 1, wherein the at least one conservative amino acid change is selected from the group consisting of: K284E, S143N, L502M, L403I, A387S, S86K, F90H, K196E, K214E, K373E, L259F, K511E, L159M, R479Q, L483M, I82V, F90Y, L89I, V266I, L481I, L202M, L259V, L150M, R85K, Y151F, Y482F, S488T, V45I, S80T, and K196T.

4. The isolated nucleic acid sequence of claim 1, wherein the at least one conservative amino acid change is made to a residue selected from the group consisting of V45, I82, V266, and F90.

5. The isolated nucleic acid sequence of claim 1, wherein the at least one conservative amino acid change is selected from the group consisting of V45I, I82V, V266I, and F90Y.

6. The isolated nucleic acid sequence of claim 1, wherein the immune optimised functional variant of the yeast NDI1 protein of SEQ ID NO: 542 comprises at least two of the at least one conservative amino acid changes.

7. The isolated nucleic acid sequence of claim 1, wherein the immune optimised functional variant of the yeast NDI1 protein of SEQ ID NO: 542 comprises at least three, four, five or six of the at least one conservative amino acid changes.

8. The isolated nucleic acid sequence of claim 1 that comprises at least 50 codons which are codon optimised compared with the sequence of wild-type yeast NDI1 gene of SEQ ID NO: 1.

9. The isolated nucleic acid sequence of claim 1, wherein the nucleic acid comprises 300 or 329 codons which are codon optimised compared with the sequence of wild-type yeast NDI1 gene of SEQ ID NO: 1.

10. The isolated nucleic acid sequence of claim 1, encoding an immune optimised functional variant of the yeast NDI1 protein having at least 95% sequence identity with SEQ ID NO: 542.

11. The isolated nucleic acid sequence of claim 1 wherein said nucleic acid sequence has a sequence selected from SEQ ID NOs: 75-78, 80-88, 90-91, 93-99, 101-107, 109-110, 112-126, 129-133, 136-145, 165-168, 170-171, 173-180, 183-184, 186-192, 194-197, 199-204, 207-211, 213, 215-219, 221, 223, 226-230, 232-238, 241-243, 264, 265, 267-268, 271, 273-278, 282, 283, 285-289, 291, 293-299, 301-304, 306-310, 313-315, 317-331, 333-334, 336, 339-340, 363-369, 371-372, 374, 376-384, 391-392, 394-397, 399, 405, 407, 414, 418-420, 422-425, 428, 430-431, 433-434, 438-439, 466, 468, 470, 472-473, 475-478, 482, 487, 492, 494, 499, 501, 506, 510, 518-519, 527, 533, 535, 539, 705-824, 835-884, 895-944 and 955-1004.

12. A nucleic acid construct comprising the nucleic acid sequence of claim 1 and a nucleic acid sequence encoding a mitochondrial localisation sequence.

13. A vector comprising the nucleic acid sequence of claim 1.

14. The vector of claim 13, wherein the vector is an adeno-associated virus (AAV).

15. The vector of claim 13, further comprising a gene that enhances cell survival and or cell function.

16. An adeno-associated virus (AAV) vector comprising the nucleic acid sequence of claim 1 and a nucleic acid sequence encoding a mitochondrial localization sequence.

17. The isolated nucleic acid sequence of claim 1, wherein 1 to 329 codons are codon optimized compared with the sequence of wild-type yeast NDI1 gene of SEQ ID NO: 1.

18. The vector of claim 15, wherein the gene that enhances cell survival or cell function is selected from a gene encoding a neurotrophic factor, a growth factor, an anti-apoptotic agent, an antioxidant, a cytokine or a hormone.

19. An isolated nucleic add sequence encoding a functional variant of the yeast NDI1 protein of SEQ ID NO: 542, wherein said functional variant has at least 99% sequence identity with the polypeptide sequence corresponding to amino add residues 28 to 513 of SEQ ID NO: 542, wherein the nucleic add comprises 50-329 codons which are codon optimised compared with the sequence of wild-type yeast NDI1 gene of SEQ ID NO: 1,
   wherein said functional variant, when compared to the sequence of the polypeptide sequence corresponding to amino acid residues 28 to 513 of SEQ ID NO: 542, comprises at least one conservative amino acid change to a residue selected from the group consisting of: K284, S143, L502, L403, A387, S86, K214, K373 K511, R479, L483, I82, F90, L89 V266, L481, L202, R85, Y151, Y482, S488, V45, S80, and K196.

* * * * *